United States Patent 11,931,406 (FLAVIVIRUS VACCINE) - sequence listing, part 6

SEQ ID NO: 4664 - protein, 3290 aa, Artificial Sequence
  derived and/or modified protein sequence (wt) from DENV-3__GU131908__SS-prME
TSLCLMMMLPATLAFHLTSRDGEPRMIVGKNERGKSLLFKTASGINMCTLIAMDLGEMCDDTVTYKCPLIAEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKSKPTLDIELQKTEATQLATLRKLCIEGKITNITTDSRCPTQGEATLPEEQDQNYVCKHTYVDRGWGNGCGLFGKGSLVTCAKFQCLEPIEGKVVQYENLKYTVIITVHTGDQHQVGNDTQGVTVEITPQASTVEAVLPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCLNTFVLKKEVSETQHGTILIKVEYKGEDAPCKIPFSTEDGQGKAHNGRLITANPVVTKKEEPVNIEAEPPFGESNIVIGIGDKALKINWYKKGSSIGKMFEATARGARRMAILGDTAWDFGSVGGVLNSLGKMVHQIFGSAYTALFSGVSWIMKIGIGVLLTWIGLNSKNTSMSFSCIVIGIITLYLGAVVQADMGCAINWKGKELKCGSGIFVTNEVHTWTEQYKFQADSPKRLATAIAGAWKNGVCGIRSTTRMENLLWKQIANELNYILWENNIKLTVVVGDIIGVLEQGKRTLTPQPMELKYSWKTWGKAKIVTAETQNSSFIIDGPNTPECPSASRAWNVWEVEDYGFGVFTTNIWLKLREVYTQSCDHRLMSAAIKDERAVHADMGYWIESQKNGSWKLEKASFIEVKTCTWPKSHTLWSNGVLESDMIIPKSLAGPISQHNHRPGYHTQTAGPWHLGKLELDFNYCEGTTVVITENCGTRGPSLRTTTVSGKLIHEWCCRSCTLPPLRYMGEDGCWYGMEIRPINEKEENMVKSLVSAGSGKVDNFTMGVLCLAILFEEVMRGKFGKKHMIAGVLFTFVLLLSGQITWRDMAHTLIMIGSNASDRMGMGVTYLALIATFKIQPFLALGFFLRKLTSRENLLLGVGLAMATTLQLPEDIEQMANGIALGLMTLKLITQFETYQLWTALVSLTCSNTIFTLTVAWRTATLILAGVSLLPLCQSSSMRKTDWLPMTVAAMGVPPLPLFIFSLKDTPKRRSWPLNEGVMAVGLVSILASSLLRNDVPMAGPLVAGGLLIACYVITGTSADLTVEKAADVTWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTHNGKRLEPNWASVKKDLISYGGGWRLNAQWQKGEEVQVIAVEPGKNPKNFQTMPGIFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLVIMDEAHFTDPASIAARGYISTRVGMGEAAAIFMTATPPGTAEAFPQSNAPIQDEERDIPERSWNSGNEWITDFVGKTVWFVPSIKAGNDIANCLRKNGKKVIQLSRKTFDTEYQKTRLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGERNNQILEENMDVEIWTKEGERKKLRPRWLDARTYSDPLALKEFKDFAAGRKSIALDLVTEIGRVPSHLAHRTRNALDNLVMLHTSEHGGRAYRHAVEELPETMETLLLLGLMILLTGGAMLFLISGKGIGKTSIGLICVIVSSGMLWMADVPLQWIASAIVLEFFMMVLLIPEPEKQRTPQDNQLAYVVIGILTLAAIVAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLVTHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGRRGTGSQGETLGEKWKKKLNQLSRKEFDLYKKSGITEVDRTEAKEGLKRGETTHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLRNNQFCIKVLNPYMPTVIEHLERLQRKYGGMLVRNPLSRNSTHEMYWISNGTGNIVSSVNMVSRLLLNRFTMTHRRPTIEKDVDLGAGTRHVNAEPETPNMDVIGERIKRIKEEHSSTWHYDDENPYKTWAYHGSYEVKATGSASSMINGVVKLLTKPWDVVPMVTQMAMTDTTPFGQQRVFKEKVDTRTPRPMPGTRKVMEITAEWLWRTLGRNKKPRLCTREEFTKKVRTNAAMGAVFTEENQWDSARAAVEDEEFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPKGTVMDIISRKDQRGSGQVGTYGLNTFTNMEAQLVRQMEGEGVLSKADLENPHLLEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLKETACLGKAYAQMWSLMYFHRRDLRLASNAICSAVPVHWIPTSRTTWSIHAHHQWMTTEDMLTVWNRVWIEDNPWMEDKTPVTTWEDVPYLGKREDQWCGSLIGLTSRATWAQNILTAIQQVRSLIGDEEFLDYMPSMKRFRKEEESEGAIW

SEQ ID NO: 4665 - protein, 3290 aa, Artificial Sequence
  derived and/or modified protein sequence (wt) from DENV-3__GU131909__SS-prME
TSLCLMMMLPATLAFHLTSRDGEPRMIVGKNERGKSLLFKTASGINMCTLIAMDLGEMCDDTVTYKCPLIAEVEPEDIDCWCNLTSTWVTYGTCNQAGEHRRDKRSVALAPHVGMGLDTRTQTWMSAEGAWRQVEKVETWAFRHPGFTILALFLAHYIGTSLTQKVVIFILLMLVTPSMTMRCVGVGNRDFVEGLSGATWVDVVLEHGGCVTTMAKSKPTLDIELQKTEATQLATLRKLCIEGKITNITTDSRCPTQGEATLPEEQDQNYVCKHTYVDRGWGNGCGLFGKGSLVTCAKFQCLEPIEGKVVQYENLKYTVIITVHTGDQHQVGNDTQGVTVEITPQASTVEAVLPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCLNTFVLKKEVSETQHGTILIKVEYKGEDAPCKIPFSTEDGQGKAHNGRLITANPVVTKKEEPVNIEAEPPFGESNIVIGIGDKALKINWYKKGSSIGKMFEATARGARRMAILGDTAWDFGSVGGVLNSLGKMVHQIFGSAYTALFSGVSWIMKIGIGVLLTWIGLNSKNTSMSFSCIVIGIITLYLGAVVQADMGCAINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSASRAWNVWEVEDYGFGVFTTNIWLKLREVYTQSCDHRLMSAAIKDERAVHADMGYWIESQKNGSWKLEKASFIEVKTCTWPKSHTLWSNGVLESDMIIPKSLAGPISQHNHRPGYHTQTAGPWHLGKLELDFNYCEGTTVVITENCGTRGPSLRTTTVSGKLIHEWCCRSCTLPPLRYMGEDGCWYGMEIRPINEKEENMVKSLVSAGSGKVDNFTMGVLCLAILFEEVMRGKFGKKHMIAGVLFTFVLLLSGQITWRDMAHTLIMIGSNASDRMGMGVTYLALIATFKIQPFLALGFFLRKLTSRENLLLGVGLAMATTLQLPEDIEQMANGIALGLMTLKLITQFETYQLWTALVSLTCSNTIFTLTVAWRTATLILAGVSLLPLCQSSSMRKTDWLPMTVAAMGVPPLPLFIFSLKDTPKRRSWPLNEGVMAVGLVSILASSLLRNDVPMAGPLVAGGLLIACYVITGTSADLTVEKAADVTWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTHNGKRLEPNWASVKKDLISYGGGWRLNAQWQKGEEVQVIAVEPGKNPKNFQTMPGIFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLVIMDEAHFTDPASIAARGYISTRVGMGEAAAIFMTATPPGTAEAFPQSNAPIQDEERDIPERSWNSGNEWITDFVGKTVWFVPSIKAGNDIANCLRKNGKKVIQLSRKTFDTEYQKTRLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGERNNQILEENMDVEIWTKEGERKKLRPRWLDARTYSDPLALKEFKDFAAGRKSIALDLVTEIGRVPSHLAHRTRNALDNLVMLHTSEHGGRAYRHAVEELPETMETLLLLGLMILLTGGAMLFLISGKGIGKTSIGLICVIVSSGMLWMADVPLQWIASAIVLEFFMMVLLIPEPEKQRTPQDNQLAYVVIGILTLAAIVAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLVTHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGRRGTGSQGETLGEKWKKKLNQLSRKEFDLYKKSGITEVDRTEAKEGLKRGETTHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLRNNQFCIKVLNPYMPTVIEHLERLQRKYGGMLVRNPLSRNSTHEMYWISNGTGNIVSSVNMVSRLLLNRFTMTHRRPTIEKDVDLGAGTRHVNAEPETPNMDVIGERIKRIKEEHSSTWHYDDENPYKTWAYHGSYEVKATGSASSMINGVVKLLTKPWDVVPMVTQMAMTDTTPFGQQRVFKEKVDTRTPRPMPGTRKVMEITAEWLWRTLGRNKKPRLCTREEFTKKVRTNAAMGAVFTEENQWDSARAAVEDEEFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPKGTVMDIISRKDQRGSGQVGTYGLNTFTNMEAQLVRQMEGEGVLSKADLENPHLLEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLKETACLGKAYAQMWSLMYFHRRDLRLASNAICSAVPVHWIPTSRTTWSIHAHHQWMTTEDMLTVWNRVWIEDNPWMEDKTPVTTWEDVPYLGKREDQWCGSLIGLTSRATWAQNILTAIQQVRSLIGDEEFLDYMPSMKRFRKEEESEGAIW

SEQ ID NO: 4666 - protein, 3290 aa, Artificial Sequence
  derived and/or modified protein sequence (wt) from DENV-3__GU131912__SS-prME
TSLCLMMMLPATLAFHLTSRDGEPRMIVGKNERGKSLLFKTASGINMCTLIAMDLGEMCDDTVTYKCPLIAEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKSKPTLDIELQKTEATQLATLRKLCIEGKITNITTDSRCPTQGEATLPEEQDQNYVCKHTYVDRGWGNGCGLFGKGSLVTCAKFQCLEPIEGKVVQYENLKYTVIITVHTGDQHQVGNDTQGVTVEITPQASTVEAVLPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTNIFAGHLKCRLKMDKLELKGMSYAMCLNTFVLKKEVSETQHGTILIKVEYKGEDAPCKIPFSTEDGQGKAHNGRLITANPVVTKKEEPINIEAEPPFGESNIVIGIGDKALKINWYKKGSSIGKMFEATARGARRMAILGDTAWDFGSVGGVLNSLGKMVHQIFGSAYTALFSGVSWIMKIGIGVLLTWIGLNSKNTSMSFSCIVIGIITLYLGAVVQADMGCVINWKGKELKCGNGIFVTNEVHTWTEQYKFQADSPKRLATAIAGSWENGVCGIRSTTRMENLLWKQIANELNYILWENNIKLTVVVGDIIGVLEQGKRTLTPQPMELKYSWKTWGKAKIVTAETQNSSFIIDGPNTPECPSASRAWNVWEVEDYGFGVFTTNIWLKLREVYTQSCDHRLMSAAIKDERAVHADMGYWIESQKNGSWKLEKASFIEVKTCTWPKSHTLWSNGVLESDMIIPKSLAGPISQHNHRPGYHTQTAGPWHLGKLELDFNYCEGTTVVIAENCGTRGPSLRTTTVSGKLIHEWCCRSCTLPPLRYMGEDGCWYGMEIRPINEKEENMVKSLVSAGSGKVDNFTMGVLCLAILFEEVMRGKFGKKHMIAGVLFTFVLLLSGQITWRDMAHTLIMIGSNASDRMGMGVTYLALIATFKIQPFLALGFFLRKLTSRENLLLGVGLAMATTLQLPEDIEQMANGIALGLMTLKLITQFETYQLWTALVSLTCSNTIFTLTVAWRTATLILAGVSLLPLCQSSSMRKTDWLPMTVAAMGVPPLPLFIFSLKDTPKRKSWPLNEGVMAVGLVSILASSLLRNDVPMAGPLVAGGLLIACYVITGTSADLTVEKAADVTWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTHNGKRLEPNWASVKKDLISYGGGWRLSAQWQKGEEVQVIAVEPGKNPKNFQTMPGIFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTASKSEHTGREIVDLMCHATFTMRLLSPVRVPNYNLIIMDEAHFTDPASIAARGYISTRVGMGEAAAIFMTATPPGTAEAFPQSNAPIQDEERDIPERSWNSGNEWITDFVGKTVWFVPSIKAGNDIANCLRKNGKKVIQLSRKTFDTEYQKTRLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGERNNQILEENMDVEIWTKEGERKKLRPRWLDARTYSDPLALKEFKDFAAGRKSIALDLVTEIGRVPSHLAHRTRNALDNLVMLHTSEHGGRAYRHAVEELPETMETLLLLGLMILLTGGAMLFLISGKGIGKTSIGLICVIVSSGMLWMADVPLQWIASAIVLEFFMMVLLIPEPEKQRTPQDNQLAYVVIGILTLAAIVAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLVTHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGRRGTGSQGETLGEKWKKKLNQLSRKEFDLYKKSGITEVDRTEAKEGLKRGETTHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLRMVEPWLRNNQFCIKVLNPYMPNVIEHLERLQRKYGGMLVRNPLSRNSTHEMYWISNGTGNIVSSVNMVSRLLLNRFTMTHRRPTIEKDVDLGAGTRHVNAEPETPNMDVIGERIKRIKEEHSSTWHYDDENPYKTWAYHGSYEVKATGSASSMINGVVKLLTKPWDVVPMVTQMAMTDTTPFGQQRVFKEKVDTRTPRPMPGTRKVMEITAEWLWRTLGRNKKPRLCTREEFTKKVRTNAAMGAVFTEENQWDSARAAVEDEEFWKLVDKERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPKGTVMDIISRKDQRGSGQVGTYGLNTFTNMEAQLVRQMEGEGVLSEADLENPHLLEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLKETACLGKAYAQMWSLMYFHRRDLRLASNAICSAVPVHWIPTSRTTWSIHAHHQWMTTEDMLTVWNRVWIEDNPWMEDKTPVTTWEDVPYLGKREDQWCGSLIGLTSRATWAQNILTAIQQVRSLIGDEEFLDYMPSMKRFRKEEESEGAIW

SEQ ID NO: 4667 - protein, 3290 aa, Artificial Sequence
  derived and/or modified protein sequence (wt) from DENV-3__GU131913__SS-prME
TSLCLMMMLPATLAFHLTSRDGEPRMIVGKNERGKSLLFKTASGINMCTLIAMDLGEMCDDTVTYKCPLIAEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKSKPTLDIELQKTEATQLATLRKLCIEGKITNITTDSRCPTQGEATLPEEQDQNYVCKHTYVDRGWGNGCGLFGKGSLVTCAKFQCLEPIEGKVVQYENLKYTVIITVHTGDQHQVGNDTQGVTVEITPQASTVEAVLPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCLNTFVLKKEVSETQHGTILIKVEYKGEDAPCKIPFSTEDGQGKAHNGRLITANPVVTKKEEPINIEAEPPFGESNIVIGIGDKALKINWYKKGSSIGKMFEATARGARRMAILGDTAWDFGSVGGVLNSLGKMVHQIFGSAYTALFSGVSWIMKIGIGVLLTWIGLNSKNTSMSFSCIVIGIVTLYLGAVVQADMGCVINWKGKELKCGNGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSASRAWNVWEVEDYGFGVFTTNIWLKLREVHTQSCDHRLMSAAIKDERAVHADMGYWIESQKNGSWKLEKASFIEVKTCTWPKSHTLWSNGVLESDMIIPKSLAGPISQHNHRPGYHTQTAGPWHLGKLELDFNYCEGTTVVIAENCGTRGPSLRTTTVSGKLIHEWCCRSCTLPPLRYMGEDGCWYGMEIRPINEKEENMVKSLVSAGSGKVDNFTMGVLCLAILFEEVMRGKFGKKHMIAGVLFTFVLLLSGQITWRDMAHTLIMIGSNASDRMGMGVTYLALIATFKIQPFLALGFFLRKLTSRENLLLGVGLAMATTLQLPEDIEQMANGIALGLMTLKLITQFETYQLWTALVSLTCSNTIFTLTVAWRTATLILAGVSLLPLCQSSSMRKTDWLPMTVAAMGVPPLPLFIFSLKDTPKRKSWPLNEGVMAVGLVSILASSLLRNDVPMAGPLVAGGLLIACYVITGTSADLTVEKAADVTWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTHNGKRLEPNWASVKKDLISYGGGWRLSAQWQKGEEVQVIAVEPGKNPKNFQTMPGIFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLVIMDEAHFTDPASIAARGYISTRVGMGEAAAIFMTATPPGTAEAFPQSNAPIQDEERDIPERSWNSGNEWITDFVGKTVWFVPSIKAGNDIANCLRKNGKKVIQLSRKTFDTEYQKTRLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGERNNQILEENMDVEIWTKEGERKKLRPRWLDARTYSDPLALKEFKDFAAGRKSIALDLVTEIGRVPSHLAHRTRNALDNLVMLHTSEHGGRAYRHAVEELPETMETLLLLGLMILLTGGAMLFLISGKGIGKTSIGLICVIVSSGMLWMADVPLQWIASAIVLEFFMMVLLIPEPEKQRTPQDNQLAYVVIGILTLAAIVAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLVTHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGRRGTGSQGETLGEKWKKKLNQLSRKEFDLYKKSGITEVDRTEAKEGLKRGETTHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLRNNQFCIKVLNPYMPNVIEHLERLQRKYGGMLVRNPLSRNSTHEMYWISNGTGNIVSSVNMVSRLLLNRFTMTHRRPTIEKDVDLGAGTRHVNAEPETPNMDVIGERIKRIKEEHSSTWHYDDENPYKTWAYHGSYEVKATGSASSMINGVVKLLTKPWDVVPMVTQMAMTDTTPFGQQRVFKEKVDTRTPRPMPGTRKVMEITAEWLWRTLGRNKKPRLCTREEFTKKVRTNAAMGAVFTEENQWDSARAAVEDEEFWKLVDKERELHKLGKCGSCVYNMMGKREKKLGEFGKAKGSRAIWYMWLGARFLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPKGTVMDIISRKDQRGSGQVGTYGLNTFTNMEAQLVRQMEGEGVLSEADLENPHLLEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLKETACLGKAYAQMWSLMYFHRRDLRLASNAICSAVPVHWIPTSRTTWSIHAHHQWMTTEDMLTVWNRVWIEDNPWMGDKTPVTTWEDVPYLGKREDQWCGSLIGLTSRATWAQNILTAIQQVRSLIGDEEFLDYMPSMKRFRKEEESEGAIW

SEQ ID NO: 4668 - protein, 3290 aa, Artificial Sequence
  derived and/or modified protein sequence (wt) from DENV-3__GU131914__SS-prME
TSLCLMMMLPATLAFHLTSRDGEPRMIVGKNERGKSLLFKTASGINMCTLIAMDLGEMCDDTVTYKCPLIAEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKSKPTLDIELQKTEATQLATLRKLCIEGKITNITTDSRCPTQGEATLPEEQDQNYVCKHTYVDRGWGNGCGLFGKGSLVTCAKFQCLEPIEGKVVQYENLKYTVIITVHTGDQHQVGNDTQGVTVEITPQASTVEAVLPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCLNTFVLKKEVSETQHGTILIKVEYKGEDAPCKIPFSTEDGQGKAHNGRLITANPVVTKKEEPINIEAEPPFGESNIVIGIGDKALKINWYKKGSSIGKMFEATARGARRMAILGDTAWDFGSVGGVLNSLGKMVHQIFGSAYTALFSGVSWIMKIGIGVLLTWIGLNSKNTSMSFSCIVIGIITLYLGAVVQADMGCVINWKGKELKCGNGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSASRAWNVWEVEDYGFGVFTTNIWLKLREVHTQSCDHRLMSAAIKDERAVHADMGYWIESQKNGSWKLEKASFIEVKTCTWPKSHTLWSNGVLESDMIIPKSLAGPISQHNHRPGYHTQTAGPWHLGKLELDFNYCEGTTVVIAENCGTRGPSLRTTTVSGKLIHEWCCRSCTLPPLRYMGEDGCWYGMEIRPINEKEENMVKSLVSAGSGKVDNFTMGVLCLAILFEEVMRGKFGKKHMIAGVLFTFVLLLSGQITWRDMAHTLIMIGSNASDRMGMGVTYLALIATFKIQPFLALGFFLRKLTSRENLLLGVGLAMATTLQLPEDIEQMANGIALGLMTLKLITQFETYQLWTALVSLTCSNTIFTLTVAWRTATLILAGVSLLPLCQSSSMRKTDWLPMTVAAMGVPPLPLFIFSLKDTPKRKSWPLNEGVMAVGLVSILASSLLRNDVPMAGPLVAGGLLIACYVITGTSADLTVEKAADVTWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTHNGKRLEPNWASVKKDLISYGGGWRLSAQWQKGEEVQVIAVEPGKNPKNFQTMPGIFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLVIMDEAHFTDPASIAARGYISTRVGMGEAAAIFMTATPPGTAEAFPQSNAPIQDEERDIPERSWNSGNEWITDFVGKTVWFVPSIKAGNDIANCLRKNGKKVIQLSRKTFDTEYQKTRLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGERNNQILEENMDVEIWTKEGERKKLRPRWLDARTYSDPLALKEFKDFAAGRKSIALDLVTEIGRVPSHLAHRTRNALDNLVMLHTSEHGGRAYRHAVEELPETMETLLLLGLMILLTGGAMLFLISGKGIGKTSIGLICVIVSSGMLWMADVPLQWIASAIVLEFFMMVLLIPEPEKQRTPQDNQLAYVVIGILTLAAIVAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLVTHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGRRGTGSQGETLGEKWKKKLNQLSRKEFDLYKKSGITEVDRTEAKEGLKRGETTHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLRNNQFCIKVLNPYMPNVIEHLERLQRKYGGMLVRNPLSRNSTHEMYWISNGTGNIVSSVNMVSRLLLNRFTMTHRRPTIEKDVDLGAGTRHVNAEPETPNMDVIGERIKRIKEEHSSTWHYDDENPYKTWAYHGSYEVKATGSASSMINGVVKLLTKPWDVVPMVTQMAMTDTTPFGQQRVFKEKVDTRTPRPMPGTRKVMEITAEWLWRTLGRNKKPRLCTREEFTKKVRTNAAMGAVFTEENQWDSARAAVEDEEFWKLVDKERELHKLGKCGSCVYNMMGKREKKLGEFGKAKGSRAIWYMWLGARFLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPKGTVMDIISRKDQRGSGQVGTYGLNTFTNMEAQLVRQMEGEGVLSEADLENPHLLEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLKETACLGKAYAQMWSLMYFHRRDLRLASNAICSAVPVHWIPTSRTTWSIHAHHQWMTTEDMLTVWNRVWIEDNPWMGDKTPVTTWEDVPYLGKREDQWCGSLIGLTSRATWAQNILTAIQQVRSLIGDEEFLDYMPSMKRFRKEEESEGAIW

SEQ ID NO: 4669 - protein, 3290 aa, Artificial Sequence
  derived and/or modified protein sequence (wt) from DENV-3__GU131915__SS-prME
TSLCLMMMLPATLAFHLTSRDGEPRMIVGKNERGKSLLFKTASGINMCTLIAMDLGEMCDDTVTYKCPLIAEAEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKSKPTLDIELQKTEATQLATLRKLCIEGKITNITTDSRCPTQGEATLPEEQDQNYVCKHTYVDRGWGNGCGLFGKGSLVTCAKFQCLEPIEGKVVQHENLKYTVIITVHTGDQHQVGNDTQGVTVEITPQASTVEAVLPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCLNTFVLKKEVSETQHGTILIKVEYKGEDAPCKIPFSTEDGQGKAHSGRLITANPVVTKKEEPVNIEAEPPFGESNIVIGIGDKALKINWYKKGSSIGKMFEATARGARRMAILGDTAWDFGSVGGVLNSLGKMVHQIFGSAYTALFSGVSWIMKIGIGVLLTWIGLNSKNTSMSFSCIVIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSASRAWNVWEVEDYGFGVFTTNIWLKLREVYTQSCDHRLMSAAIKDERAVHADMGYWIESQKNGSWKLEKASFIEVKTCTWPKSHTLWSNGVLESDMIIPKSLAGPISQHNHRPGYHTQTAGPWHLGKLELDFNYCEGTTVVITENCGTRGPSLRTTTVSGKLIHEWCCRSCTLPPLRYMGEDGCWYGMEIRPINEKEENMVKSLVSAGSGKVDNFTMGVLCLAILFEEVMRGKFGKKHMIAGVLFTFVLLLSGQITWRDMAHTLIMIGSNASDRMGMGVTYLALIATFKIQPFLALGFFLRKLTSRENLLLGVGLAMATTLQLPEDIEQMANGIALGLMTLKLITQFETYQLWTALVSLTCSNTIFTLTVAWRTATLILAGVSLLPLCQSSSMRKTDWLPMTVAAMGVPPLPLFIFSLKDTPKRRSWPLNEGVMAVGLVSILASSLLRNDVPMAGPLVAGGLLIACYVITGTSADLTVEKAADVTWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTHNGKRLEPNWASVKKDLISYGGGWRLNAQWQKGEEVQVIAVEPGKNPKNFQTMPGIFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLVIMDEAHFTDPASIAARGYISTRVGMGEAAAIFMTATPPGTAEAFPQSNAPIQDEERDIPERSWNSGNEWITDFVGKTVWFVPSIKAGNDIANCLRKNGKKVIQLSRKTFDTEYQKTRLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGERNNQILEENMDVEIWTKEGERKKLRPRWLDARTYSDPLALKEFKDFAAGRKSIALDLVTEIGRVPSHLAHRTRNALDNLVMLHTSEHGGRAYRHAVEELPETMETLLLLGLMILLTGGAMLFLISGKGIGKTSIGLICVIVSSGMLWMADVPLQWIASAIVLEFFMMVLLIPEPEKQRTPQDNQLAYVVIGILTLAAIVAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLVTHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGRRGTGSQGETLGEKWKKKLNQLSRKEFDLYKKSGITEVDRTEAKEGLKRGETTHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLRNNQFCIKVLNPYMPTVIEHLERLQRKYGGMLVRNPLSRNSTHEMYWISNGTGNIVSSVNMVSRLLLNRFTMTHRRPTIEKDVDLGAGTRHVNAEPETPNMDVIGERIKRIKEEHSSTWHYDDENPYKTWAYHGSYEVKATGSASSMINGVVKLLTKPWDVVPMVTQMAMTDTTPFGQQRVFKEKVDTRTPRPMPGTRKVMEITAEWLWRTLGRNKKPRLCTREEFTKKVRTNAAMGAVFTEENQWDSARAAVEDEEFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPKGTVMDIISRKDQRGSGQVGTYGLNTFTNMEAQLVRQMEGEGVLSKADLENPHLLEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLKETACLGKAYAQMWSLMYFHRRDLRLASNAICSAVPVHWIPTSRTTWSIHAHHQWMTTEDMLTVWNRVWIEDNPWMEDKTPVTTWEDVPYLGKREDQWCGSLIGLTSRATWAQNILTAIQQVRSLIGDEEFLDYMPSMKRFRKEEESEGAIW

SEQ ID NO: 4670 - protein, 3290 aa, Artificial Sequence
  derived and/or modified protein sequence (wt) from DENV-3__GU131916__SS-prME
TSLCLMMMLPATLAFHLTSRDGEPRMIVGKNERGKSLLFKTASGINMCTLIAMDLGEMCDDTVTYKCPLIAEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKSKPTLDIELQKTEATQLATLRKLCIEGKITNITTDSRCPTQGEATLPEEQDQNYVCKHTYVDRGWGNGCGLFGKGSLVTCAKFQCLEPIEGKVVQYENLKYTVIITVHTGDQHQVGNDTQGVTVEITPQASTVEAVLPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCLNTFVLKKEVSETQHGTILIKVEYKGEDAPCKIPFSTEDGQGKAHNGRLITANPVVTKKEEPVNIEAEPPFGESNIVIGIGDKALKINWYKKGSSIGKMFEATARGARRMAILGDTAWDFGSVGGVLNSLGKMVHQIFGSAYTALFSGVSWIMKIGIGVLLTWIGLNSKNTSMSFSCIVIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSASRAWNVWEVEDYGFGVFTTNIWLKLREVYTQSCDHRLMSAAIKDERAVHADMGYWIESQKNGSWKLEKASFIEVKTCTWPKSHTLWSNGVLESDMIIPKSLAGPISQHNHRPGYHTQTAGPWHLGKLELDFNYCEGTTVVITENCGTRGPSLRTTTVSGKLIHEWCCRSCTLPPLRYMGEDGCWYGMEIRPINEKEENMVKSLVSAGSGKVDNFTMGVLCLAILFEEVMRGKFGKKHMIAGVLFTFVLLLSGQITWRDMAHTLIMIGSNASDRMGMGVTYLALIATFKIQPFLALGFFLRKLTSRENLLLGVGLAMATTLQLPEDIEQMANGIALGLMTLKLITQFETYQLWTALVSLTCSNTIFTLTVAWRTATLILAGVSLLPLCQSSSMRKTDWLPMTVAAMGVPPLPLFIFSLKDTPKRRSWPLNEGVMAVGLVSILASSLLRNDVPMAGPLVAGGLLIACYVITGTSADLTVEKAADVTWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTHNGKRLEPNWASVKKDLISYGGGWRLSAQWQKGEEVQVIAVEPGKNPKNFQTMPGIFQTTTGEIGAIALDFKPGTSGSPIINREGKVVGLYGNGVITKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLVIMDEAHFTDPASIAARGYISTRVGMGEAAAIFMTATPPGTAEAFPQSNAPIQDEERDIPERSWNSGNEWITDFVGKTVWFVPSIKAGNDIANCLRKNGKKVIQLSRKTFDTEYQKTRLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGERNNQILEENMDVEIWTKEGERKKLRPRWLDARTYSDPLALKEFKDFAAGRKSIALDLVTEIGRVPSHLAHRTRNALDNLVMLHTSEHGGRAYRHAVEELPETMETLLLLGLMILLTSGAMLFLISGKGIGKTSIGLICVIVSSGMLWMADVPLQWIASAIVLEFFMMVLLIPEPEKQRTPQDNQLAYVVIGILTLAAIVAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLVTHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGRRGTGSQGETLGEKWKKKLNQLSRKEFDLYKKSGITEVDRTEAKEGLKRGETTHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLRNNQFCIKVLNPYMPTVIEHLERLQRKYGGMLVRNPLSRNSTHEMYWISNGTGNIVSSVNMVSRLLLNRFTMTHRRPTIEKDVDLGAGTRHVNAEPETPNMDVIGERIKRIKEEHSSTWHYDDENPYKTWAYHGSYEVKATGSASSMINGVVKLLTKPWDVVPMVTQMAMTDTTPFGQQRVFKEKVDTRTPRPMPGTRKVMEITAEWLWRTLGRNKKPRLCTREEFTKKVRTNAAMGAVFTEENQWDSARAAVEDEEFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPKGTVMDIISRKDQRGSGQVGTYGLNTFTNMEAQLVRQMEGEDVLSKADLENPHLLEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLKETACLGKAYAQMWSLMYFHRRDLRLASNAICSAVPVHWIPTSRTTWSIHAHHQWMTTEDMLTVWNRVWIEDNPWMEDKTPVTTWEDVPYLGKREDQWCGSLIGLTSRATWAQNILTAIQQVRSLIGDEEFSDYMPSMKRFRKEEESEGAIW

SEQ ID NO: 4671 - protein, 3290 aa, Artificial Sequence
  derived and/or modified protein sequence (wt) from DENV-3__GU131917__SS-prME
TSLCLMMMLPATLAFHLTSRDGEPRMIVGKNERGKSLLFKTASGINMCTLIAMDLGEMCDDTVTYKCPLIAEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFTLLMLVTPSMTMRCVGVGNRDFVEGLSGATWVDVVLEHGGCVTTMAKSKPTLDIELQKTEATQLATLRKLCIEGKITNITTDSRCPTQGEATLPEEQDQNYVCKHTYVDRGWGNGCGLFGKGSLVTCAKFQCLEPIEGKVVQYENLKYTVIITVHTGDQHQVGNDTQGVTVEITPQASTVEAVLPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCLNTFVLKKEVSETQHGTILIKVEYKGEDAPCKIPFSTEDGQGKAHNGRLITANPVVTKKEEPVNIEAEPPFGESNIVIGIGDKALKINWYKKGSSIGKMFEATARGARRMAILGDTAWDFGSVGGVLNSLGKMVHQIFGSAYTALFSGVSWIMKIGIGVLLTWIGLNSKNTSMSFSCIVIGIITLYLGAVVQADMGCVINWKGKELKCGNGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSASRAWNVWEVEDYGFGVFTTNIWLKLREVYTQSCDHRLMSAAIKDERAVHADMGYWIESQKNGSWKLEKASFIEVKTCTWPKSHTLWSNGVLESDMIIPKSLAGPISQHNHRPGYHTQTAGPWHLGKLELDFNYCEGTTVVIAENCGTRGPSLRTTTVSGKLIHEWCCRSCTLPPLRYMGEDGCWYGMEIRPINEKEENMVKSLVSAGSGKVDNFTMGVLCLAILFEEVMRGKFGKKHMIAGVLFTFVLLLSGQITWRDMAHTLIMIGSNASDRMGMGVTYLALIATFKIQPFLALGFFLRKLTSRENLLLGVGLAMATTLQLPEDIEQMANGIALGLMTLKLITQFETYQLWTALVSLTCSNTIFTLTVAWRTATLILAGVSLLPLCQSSSMRKTDWLPMTVAAMGVPPLPLFIFSLKDTPKRRSWPLNEGVMAVGLVSILASSLLRNDVPMAGPLVAGGLLIACYVITGTSADLTVEKAADVTWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTHNGKRLEPNWASVKKDLISYGGGWRLSAQWQKGEEVQVIAVEPGKNPKNFQTMPGIFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLVIMDEAHFTDPASIAARGYISTRVGMGEAAAIFMTATPPGTAEAFPQSNAPIQDEERDIPERSWNSGNEWITDFVGKTVWFVPSIKAGNDIANCLRKNGKKVIQLSRKTFDTEYQKTRLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGERNNQILEENMDVEIWTKEGERKKLRPRWLDARTYSDPLALKEFKDFAAGRKSIALDLVTEIGRVPSHLAHRTRNALDNLVMLHTSEHGGRAYRHAVEELPETMETLLLLGLMILLTGGAMLFLISGKGIGKTSIGLICVIVSSGMLWMADVPLQWIASAIVLEFFMMVLLIPEPEKQRTPQDNQLAYVVIGILTLAAIVAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLVTHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRSEAKEGLKRGETTHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLRNNQFCIKVLNPYMPTVIEHLERLQRKYGGMLVRNPLSRNSTHEMYWISNGTGNIVSSVNMVSRLLLNRFTMTHRRPTIEKDVDLGAGTRHVNAEPETPNMDVIGERIKRIKEEHSSTWHYDDENPYKTWAYHGSYEVKATGSASSMINGVVKLLTKPWDVVPMVTQMAMTDTTPFGQQRVFKEKVDTRTPRPMPGTRKVMEITAEWLWRTLGRNKKPRLCTREEFTKKVRTNAAMGAVFTEENQWDSARAAVEDEEFWKLVDKERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPKGTVMDIISRKDQRGSGQVGTYGLNTFTNMEAQLVRQMEGEGVLSKADLENPHLLEKKIIQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLKETACLGKAYAQMWSLMYFHRRDLRLASNAICSAVPVHWIPTSRTTWSIHAHHQWMTTEDMLSVWNRVWIEDNPWMEDKTPVTTWEDVPYLGKREDQWCGSLIGLTSRATWAQNILTAIQQVRSLIGDEEFLDYMPSMKRFRKEEESEGAIW

SEQ ID NO: 4672 - protein, 3290 aa, Artificial Sequence
  derived and/or modified protein sequence (wt) from DENV-3__GU131918__SS-prME
TSLCLMMMLPATLAFHLTSRDGEPRMIVGKNERGKSLLFKTASGINMCTLIAMDLGEMCDDTVTYKCPLIAEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKSKPTLDIELQKTEATQLATLRKLCIEGKITNITTDSRCPTQGEATLPEEQDQNYVCKHTYVDRGWGNGCGLFGKGSLVTCAKFQCLEPIEGKVVQYENLKYTVIITVHTGDQHQVGNDTQGVTVEITPQASTVEAVLPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCLNTFVLKKEVSETQHGTILIKVEYKGEDAPCKIPFSTEDGQGKAHNGRLITANPVVTKKEEPVNIEAEPPFGESNIVIGIGDKALKINWYKKGSSIGKMFEATARGARRMAILGDTAWDFGSVGGVLNSLGKMVHQIFGSAYTALFSGVSWIMKIGIGVLLTWIGLNSKNTSMSFSCIVIGIITLYLGAVVQADMGCVINWKGKELKCGNGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSASRAWNVWEVEDYGFGVFTTNIWLKLREVYTQSCDHRLMSAAIKDERAVHADMGYWIESQKNGSWKLEKASFIEVKTCTWPKSHTLWSNGVLESDMIIPKSLAGPISQHNHRPGYHTQTAGPWHLGKLELDFNYCEGTTVVITENCGTRGPSLRTTTVSGKLIHEWCCRSCTLPPLRYMGEDGCWYGMEIRPINEKEENMVKSLVSAGSGKVDNFTMGVLCLAILFEEVMRGKFGKKHMIAGVLFTFVLLLSGQITWRDMAHTLIMIGSNASDRMGMGVTYLALIATFKIQPFLALGFFLRKLTSRENLLLGVGLAMATTLQLPEDIEQMANGIALGLMTLKLITQFETYQLWTALVSLTCSNTIFTLTVAWRTATLILAGVSLLPLCQSSSMRKTDWLPMTVAAMGVPPLPLFIFSLKDTPKRRSWPLNEGVMAVGLVSILASSLLRNDVPMAGPLVAGGLLIACYVITGTSADLTVEKAADVTWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTHNGKRLEPNWASVKKDLISYGGGWRLSAQWQKGEEVQVIAVEPGKNPKNFQTMPGIFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLVIMDEAHFTDPASIAARGYISTRVGMGEAAAIFMTATPPGTAEAFPQSNAPIQDEERDIPERSWNSGNEWITDFVGKTVWFVPSIKAGNDIANCLRKNGKKVIQLSRKTFDTEYQKTRLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGERNNQILEENMDVEIWTKEGERKKLRPRWLDARTYSDPLALKEFKDFAAGRKSIALDLVTEIGRVPSHLAHRTRNALDNLVMLHTSEHGGRAYRHAVEELPETMETLLLLGLMILLTGGAMLFLISGKGIGKTSIGLICVIVSSGMLWMADVPLQWIASAIVLEFFMMVLLIPEPEKQRTPQDNQLAYVVIGILTLAAIVAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLVTHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRSEAKEGLKRGETTHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLRNNQFCIKVLNPYMPTVIEHLERLQRKYGGMLVRNPLSRNSTHEMYWISNGTGNIVSSVNMVSRLLLNRFTMTHRRPTIEKDVDLGAGTRHVNAEPETPNMDVIGERIKRIKEEHSSTWHYDDENPYKTWAYHGSYEVKATGSASSMINGVVKLLTKPWDVVPMVTQMAMTDTTPFGQQRVFKEKVDTRTPRPMPGTRKVMEITAEWLWRTLGRNKKPRLCTREEFTKKVRTNAAMGAVFTEENQWDSARAAVEDEEFWKLVDKERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPKGTVMDIISRKDQRGSGQVGTYGLNTFTNMEAQLVRQMEGEGVLSKADLENPHLLEKKIIQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLKETACLGKAYAQMWSLMYFHRRDLRLASNAICSAVPVHWIPTSRTTWSIHAHHQWMTTEDMLSVWNRVWIEDNPWMEDKTPVTTWEDVPYLGKREDQWCGSLIGLTSRATWAQNILTAIQQVRSLIGDEEFLDYMPSMKRFRKEEESEGAIW

SEQ ID NO: 4673 - protein, 3290 aa, Artificial Sequence
  derived and/or modified protein sequence (wt) from DENV-3__GU131933__SS-prME
TSLCLMMMLPATLAFHLTSRDGEPRMIVGKNERGKSLLFKTASGINMCTLIAMDLGEMCDDTVTYKCPLIAEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKSKPTLDIELQKTEATQLATLRKLCIEGKITNITTDSRCPTQGEATLPEEQDQNYVCKHTYVDRGWGNGCGLFGKGSLVTCAKFQCLEPIEGKVVQYENLKYTVIITVHTGDQHQVGNDTQGVTVEITPQASTVEAVLPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCLNTFVLKKEVSETQHGTILIKVEYKGEDAPCKIPFSTEDGQGKAHNGRLITANPVVTKKEEPVNIEAEPPFGESNIVIGIGDKALKINWYKKGSSIGKMFEATARGARRMAILGDTAWDFGSVGGVLNSLGKMVHQIFGSAYTALFSGVSWIMKIGIGVLLTWIGLNSKNTSMSFSCIVIGIITLYLGAVVQADMGCVINWKGKELKCGSGIFVTNEVHTWTEQYKFQADSPKRLATAIAGAWENGVCGIRSTTRMENLLWKQIANELNYILWENSIKLTVVVGDIIGVLEQGKRTLTPQPMELKYSWKTWGKAKIVTAETQNSSFIIDGPNTPECPSASRAWNVWEVEDYGFGVFTTNIWLKLREVYTQSCDHRLMSAAIKDERAVHADMGYWIESQKNGSWKLEKASFIEVKTCTWPKSHTLWSNGVLESDMIIPKSLAGPISQHNHRPGYHTQTAGPWHLGKLELDFNYCEGTTVVITENCGTRGPSLRTTTVSGKLIHEWCCRSCTLPPLRYMGEDGCWYGMEIRPINEKEENMVKSLVSAGSGKVDNFTMGVLCLAILFEEVMRGKFGKKHMIAGVLFTFVLLLSGQITWRDMAHTLIMIGSNASDRMGMGVTYLALIATFKIQPFLALGFFLRKLTSRENLLLGVGLAMATTLQLPEDIEQMANGIALGLMTLKLITQFETYQLWTALVSLTCSNTIFTLTVAWRTATLILAGVSLLPLCQSSSMRKTDWLPMTVAAMGVPPLPLFIFSLKDTPKRRSWPLNEGVMAVGLVSILASSLLRNDVPMAGPLVAGGLLIACYVITGTSADLTVEKAADVTWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTHNGKRLEPNWASVKKDLISYGGGWRLSAQWQKGEEVQVIAVEPGKNPKNFQTMPGIFQTTMGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLVIMDEAHFTDPASIAARGYISTRVGMGEAAAIFMTATPPGTAEAFPQSNAPIQDEERDIPERSWNSGNEWITDFVGKTVWFVPSIKAGNDIANCLRKNGKKVIQLSRKTFDTEYQKTRLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGERNNQILEENMDVEIWTKEGERKKLRPRWLDARTYSDPLALKEFKDFAAGRKSIALDLVTEIGRVPSHLAHRTRNALDNLVMLHTSEHGGRAYRHAVEELPETMETLLLLGLMILLTGGAMLFLISGKGIGKTSIGLICVIASSGMLWMADVPLQWIASAIVLEFFMMVLLIPEPEKQRTPQDNQLAYVVIGILTLAAIVAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLVTHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGRRGTGSQGETLGEKWKKKLNQLSRKEFDLYKKSGITEVDRTEAKEGLKRGETTHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLRNNQFCIKVLNPYMPTVIEHLERLQRKYGGMLVRNPLSRNSTHEMYWISNGTGNIVSSVNMVSRLLLNRFTMTHRRPTIEKDVDLGAGTRHVNAEPETPNMDVIGERIKRIKEEHSSTWHYDDENPYKTWAYHGSYEVKATGSASSMINGVVKLLTKPWDVVPMVTQMAMTDTTPFGQQRVFKEKVDTRTPRPMAGTRKVMEITAEWLWRTLGRNKKPRLCTREEFTKKVRTNAAMGAVFTEENQWDSARAAVEDEEFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPKGTVMDIISRKDQRGSGQVGTYGLNTFTNMEAQLVRQMEGEGVLSKADLENPHLLEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLKETACLGKAYAQMWSLMYFHRRDLRLASNAICSAVPVHWIPTSRTTWSIHAHHQWMTTEDMLTVWNRVWIEDNPWMEDKTPVTTWEDVPYLGKREDQWCGSLIGLTSRATWAQNILTAIQQVRSLIGDEEFLDYMPSMKRFRKEEESEGAIW

SEQ ID NO: 4674 - protein, 3290 aa, Artificial Sequence
  derived and/or modified protein sequence (wt) from DENV-3__GU131934__SS-prME
TSLCLMMMLPATLAFHLTSRDGEPRMIVGKNERGKSLLFKTASGINMCTLIAMDLGEMCDDTVTYKCPLIAEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWIDVVLEHGGCVTTMAKSKPTLDIELQKTEATQLATLRKLCIEGKITNITTDSRCPTQGEATLPEEQDQNYVCKHTYVDRGWGNGCGLFGKGSLVTCAKFQCLEPIEGKVVQYENLKYTVIITVHTGDQHQVGNDTQGVTVEITPQASTVEAVLPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCLNTFVLKKEVSETQHGTILIKVEYKGEDAPCKIPFSTEDGQGKAHNGRLITANPVVTKKEEPVNIEAEPPFGESNIVIGIGDKALKINWYKKGSSIGKMFEATARGARRMAILGDTAWDFGSVGGVLNSLGKMVHQIFGSAYTALFSGVSWIMKIGIGVLLTWIGLNSKNTSMSFSCIVIGVITLYLGAVVQADMGCVINWKGKELKCGNGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAENQNSSFIIDGPNTPECPSASRAWNVWEVEDYGFGVFTTNIWLKLREVYTQSCDHRLMSAAIKDERAVHADMGYWIESQKNGSWKLEKASFIEVKTCTWPKSHTLWSNGVLESDMIIPKSLAGPISQHNHRPGYHTQTAGPWHLGKLELDFNYCEGTTVVIAENCGTRGPSLRTTTVSGKLIHEWCCRSCTLPPLRYMGEDGCWYGMEIRPINEKEENMVKSLVSAGSGKVDNFTMGVLCLAILFEEVMRGKFGKKHMIAGVLFTFVLLLSGQITWRDMAHTLIMIGSNASDRMGMGVTYLALIATFKIQPFLALGFFLRKLTSRENLLLGVGLAMATTLQLPEDIEQMANGIALGLMTLKLITQFETYQLWTALVSLTCSNTIFTLTVAWRTATLILAGVSLLPLCQSSSMRKTDWLPMTVAAMGVPPLPLFIFSLKDTPKRRSWPLNEGVMAVGLVSILASSLLRNDVPMAGPLVAGGLLIACYVITGTSADLTVEKAADVTWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTHNGKRLEPNWASVKKDLISYGGGWRLSAQWQKGEEVQVIAVEPGKNPKNFQTIPGIFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLVIMDEAHFTDPASIAARGYISTRVGMGEAAAIFMTATPPGTAEAFPQSNAPIQDEERDIPERSWNSGNEWITDFVGKTVWFVPSIKAGNDIANCLRKNGKKVIQLSRKTFDTEYQKTRLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGERNNQILEENMDVEIWTKEGERKKLRPRWLDARTYSDPLALKEFKDFAAGRKSIALDLVTEIGRVPSHLAHRTRNALDNLVMLHTSEHGGRAYRHAVEELPETMETLLLLGLMILLTGGAMLFLISGKGIGKTSIGLICVIVSSGMLWMADVPLQWIASAIVLEFFMMVLLIPEPEKQRTPQDNQLAYVVIGILTLAAIVAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLVTHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGRRGTGSQGETLGEKWKKKLNQLSRKEFDLYKKSGITEVDRTEAKEGLKRGETTHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLRNNQFCIKVLNPYMPTVIEHLERLQRKYGGMLVRNPLSRNSTHEMYWISNGTGNIVSSVNMVSRLLLNRFTMTHRRPTIEKDVDLGAGTRHVNAEPETPNMDVIGERIKRIKEEHSSTWHYDDENPYKTWAYHGSYEVKATGSASSMINGVVKLLTKPWDVVPMVTQMAMTDTTPFGQQRVFKEKVDTRTPRPMPGTRKVMEITAEWLWRTLGRNKKPRLCTREEFTKKVRTNAAMGAVFTEENQWDSARAAVEDEEFWKLVDKERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPKGTVMDIISRKDQRGSGQVGTYGLNTFTNMEAQLVRQMEGEGVLSKADLENPHLLEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLKETACLGKAYAQMWSLMYFHRRDLRLASNAICSAVPVHWIPTSRTTWSIHAHHQWMTTEDMLTVWNRVWIEDNPWMEDKTPVTTWEDVPYLGKREDQWCGSLIGLTSRATWAQNILTAIQQVRSLIGDEEFLDYMPSMKRFRKEEETEGAIW

SEQ ID NO: 4675 - protein, 3290 aa, Artificial Sequence
  derived and/or modified protein sequence (wt) from DENV-3__GU131935__SS-prME
TSLCLMMMLPATLAFHLTSRDGEPRMIVGKNERGKSLLFKTASGINMCTLIAMDLGEMCDDTVTYKCPLIAEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKSKPTLDIELQKTEATQLATLRKLCIEGKITNITTDSRCPTQGEATLPEEQDQNYVCKHTYVDRGWGNGCGLFGKGSLVTCAKFQCLEPIEGKVVQYENLKYTVIITVHTGDQHQVGNDTQGVTVEITPQASTVEAVLPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCLNTFVLKKEVSETQHGTILIKVEYKGEDAPCKIPFSTEDGQGKAHNGRLITANPVVTKKEEPVNIEAEPPFGESNIVIGIGDKALKINWYKKGSSIGKMFEATARGARRMAILGDTAWDFGSVGGVLNSLGKMVHQIFGSAYTALFSGVSWIMKIGIGVLLTWIGLNSKNTSMSFSCIVIGIITLYLGAVVQADMGCAINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSASRAWNVWEVEDYGFGVFTTNIWLKLREVYTQSCDHRLMSAAIKDERAVHADMGYWIESQKNGSWKLEKASFIEVKTCTWPKSHTLWSNGVLESDMIIPKSLAGPISQHNHRPGYHTQTAGPWHLGKLELDFNYCEGTTVVITENCGTRGPSLRTTTVSGKLIHEWCCRSCTLPPLRYMGEDGCWYGMEIRPINEKEENMVKSLVSAGSGKVDNFTMGVLCLAILFEEVMRGKFGKKHMIAGVLFTFVLLLSGQITWRDMAHTLIMIGSNASDRMGMGVTYLALIATFKIQPFLALGFFLRKLTSRENLLLGVGLAMATTLQLPEDIEQMANGIALGLMTLKLITQFETYQLWTALVSLTCSNTIFTLTVAWRTATLILAGVSLLPLCQSSSMRKTDWLPMTVAAMGVPPLPLFIFSLKDTPKRRSWPLNEGVMAVGLVSILASSLLRNDVPMAGPLVAGGLLIACYVITGTSADLTVEKAADVTWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTHNGKRLEPNWASVKKDLISYGGGWRLNAQWQKGEEVQVIAVEPGKNPKNFQTMPGIFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLVIMDEAHFTDPASIAARGYISTRVGMGEAAAIFMTATPPGTAEAFPQSNAPIQDEERDIPERSWNSGNEWITDFVGKTVWFVPSIKAGNDIANCLRKNGKKVIQLSRKTFDTEYQKTRLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGERNNQILEENMDVEIWTKEGERKKLRPRWLDARTYSDPLALKEFKDFAAGRKSIALDLVTEIGRVPSHLAHRTRNALDNLVMLHTSEHGGRAYRHAVEELPETMETLLLLGLMILLTGGVMLFLISGKGIGKTSIGLICVIVSSGMLWMADVPLQWIASAIVLEFFMMVLLIPEPEKQRTPQDNQLAYVVIGILTLAAIVAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLVTHYAIIGPGLQAKATREAQKRTAAGIMKNPTVDGIMTIDLDPVIYDSKFEKQLGQVMLLVLCTVQLLLMRTSWALCEALTLATGPITTLWEGSPGKFWNTTIAVSMANIFRGSYLAGAGLAFSIMKSVGTGRRGTGSQGETLGEKWKKKLNQLSRKEFDLYKKSGITEVDRTEAKEGLKRGETTHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLRNNQFCIKVLNPYMPTVIEHLERLQRKYGGMLVRNPLSRNSTHEMYWISNGTGNIVSSVNMVSRLLLNRFTMTHRRPTIEKDVDLGAGTRHVNAEPETPNMDVIGERIKRIKEEHSSTWHYDDENPYKTWAYHGSYEVKATGSASSMINGVVKLLTKPWDVVPMVTQMAMTDTTPFGQQRVFKEKVDTRTPRPMPGTRKVMEITAEWLWRTLGRNKKPRLCTREEFTKKVRTNAAMGAVFTEENQWDSARAAVEDEEFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPKGTVMDIISRKDQRGSGQVGTYGLNTFTNMEAQLVRQMEGEGVLSKADLENPHLLEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLKETACLGKAYAQMWSLMYFHRRDLRLASNAICSAVPVHWIPTSRTTWSIHAHHQWMTTEDMLTVWNRVWIEDNPWMEDKTPVTTWEDVPYLGKREDQWCGSLIGLTSRATWAQNILTAIQQVRSLIGNEEFLDYMPSMKRFRKEEESEGAIW

SEQ ID NO: 4676 - protein, 3290 aa, Artificial Sequence
  derived and/or modified protein sequence (wt) from DENV-3__GU131936__SS-prME
TSLCLMMMLPATLAFHLTSRDGEPRMIVGKNERGKSLLFKTASGINMCTLIAMDLGEMCDDTVTYKCPLIAEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKSKPTLDIELQKTEATQLATLRKLCIEGKITNITTDSRCPTQGEATLPEEQDQNYVCKHTYVDRGWGNGCGLFGKGSLVTCAKFQCLESIEGKVVQYENLKYTVIITVHTGDQHQVGNDTQGVTVEITPQASTVEAVLPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCLNTFVLKKEVSETQHGTILIKVEYKGEDAPCKIPFSTEDGQGKAHNGRLITANPVVTKKEEPVNIEAEPPFGESNIVIGIGDKALKINWYKKGSSIGKMFEATARGARRMAILGDTAWDFGSVGGVLNSLGKMVHQIFGSAYTALFSGVSWIMKIGIGVLLTWIGLNSKNTSMSFSCIVIGIITLYLGAVVQADMGCVINWKGKELKCGNGIFVTNEVHTWTEQYKFQADSPKRLATAIAGAWENGVCGIRSTTRMENLLWKQIANELNYILWENNIKLTVVVGDIIGVLEQGKRALTPQPMELKYSWKTWGKAKIVTAETQNSSFIIDGPNTPECPSASRAWNVWEVEDYGFGVFTTNIWLKLREVYTQSCDHRLMSAAIKDERAVHADMGYWIESQKNGSWKLEKASFIEVKTCTWPKSHTLWSNGVLESDMIIPKSLAGPISQHNHRPGYHTQTAGPWHLGKLELDFNYCEGTTVVIAENCGTRGPSLRTTTVSGKLIHEWCCRSCTLPPLRYMGEDGCWYGMEIRPINEKEENMVKSLVSAGSGKVDNFTMGVLCLAILFEEVMRGKFGKKHMIAGVLFTFVLLLSGQITWRDMAHTLIMIGSNASDRMGMGVTYLALIATFKIQPFLALGFFLRKLTSRENLLLGVGLAMATTLQLPEDIEQMANGIALGLMTLKLITQFETYQLWTALVSLTCSNTIFTLTVAWRTATLILAGVSLLPLCQSSSMRKTDWLPMTVAAMGVPPLPLFIFSLKDTPKRRSWPLNEGVMAVGLVSILASSLLRNDVPMAGPLVAGGLLIACYVITGTSADLTVEKAADVTWEEEAEQTGVSHNLMITVDDDGTMKIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTHNGKRLEPNWASVKKDLISYGGGWRLSAQWQKGEEVQVIAVEPGKNPKNFQTMPGIFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLVIMDEAHFTDPASIAARGYISTRVGMGEAAAIFMTATPPGTAEAFPQSNAPIQDEERDIPERSWNSGNEWITDFVGKTVWFVPSIKAGNDIANCLRKNGKKVIQLSRKTFDTEYQKTRLNDWDFVVTTDISEMGANFKADRVIDPRRCLKPVILTDGPERVILAGPMPVTAASAAQRRGRVGRNPQKENDQYIFMGQPLNNDEDHAHWTEAKMLLDNINTPEGIIPALFEPEREKSAAIDGEYRLKGESRKTFVELMRRGDLPVWLAHKVASEGIKYTDRKWCFDGERNNQILEENMDVEIWTKEGERKKLRPRWLDARTYSDPLALKEFKDFAAGRKSIALDLVTEIGRVPSHLAHRTRNALDNLVMLHTSEHGGRAYRHAVEELPETMETLLLLGLMILLTGGAMLFLISGKGIGKTSIGLICVIVSSGMLWMADVPLQWIASAIVLEFFMMVLLIPEPEKQRTPQDNQLAYVVIGILTLAAIVAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLVTHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGRRGTGSQGETLGEKWKKKLNQLSRKEFDLYKKSGITEVDRTEAKEGLKRGETTHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLRSNQFCIKVLNPYMPTVIEHLERLQRKYGGMLVRNPLSRNSTHEMYWISNGTGNIVSSVNMVSRLLLNRFTMTHRRPTIEKDVDLGAGTRHVNAEPETPNMDVIGERIKRIKEEHSSTWHYDDENPYKTWAYHGSYEVKATGSASSMINGVVKLLTKPWDVVPMVTQMAMTDTTPFGQQRVFKEKVDTRTPRPMPGTRKVMEITAEWLWRTLGRNKKPRLCTREEFTKKVRTNAAMGAVFTEENQWDSARAAVEDEEFWKLVDKERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPKGTVMDIISRKDQRGSGQVGTYGLNTFTNMEAQLVRQMEGEGVLSKADLENPHLLEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLKETACLGKAYAQMWSLMYFHRRDLRLASNAICSAVPVHWIPTSRTTWSIHAHHQWMTTEDMLTVWNRVWIEDNPWMEDKTPVTTWEDVPYLGKREDQWCGSLIGLTSRATWAQNILTAIQQVRSLIGDEEFLDYMPSMKRFRKEEETEGAIW

SEQ ID NO: 4677 - protein, 3290 aa, Artificial Sequence
  derived and/or modified protein sequence (wt) from DENV-3__GU131937__SS-prME
TSLCLMMMLPATLAFHLTSRDGEPRMIVGKNERGKSLLFKTASGINMCTLIAMDLGEMCDDTVTYKCPLIAEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKSKPTLDIELQKTEATQLATLRKLCIEGKITNITTDSRCPTQGEATLPEEQDQNYVCKHTYVDRGWGNGCGLFGKGSLVTCAKFQCLEPIEGKVVQYENLKYTVIITVHTGDQHQVGNDTQGVTVEITPQASTVEAVLPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCLNTFVLKKEVSETQHGTILIKVEYKGEDAPCKIPFSTEDGQGKAHNGRLITANPVVTKKEEPVNIEAEPPFGESNIVIGIGDKALKINWYKKGSSIGKMFEATARGARRMAILGDTAWDFGSVGGVLNSLGKMVHQIFGSAYTALFSGVSWIMKIGIGVLLTWIGLNSKNTSMSFSCIVIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSTLRAWNVWEVEDYGFGVFTTNIWLKLREVYTQSCDHRLMSAAIKDERAVHADMGYWIESQKNGSWKLEKASFIEVKTCTWPKSHTLWSNGVLESDMIIPKSLAGPISQHNYRPGYHTQTAGPWHLGKLELDFNYCEGTTVVITENCGTRGPSLRTTTVSGKLIHEWCCRSCTLPPLRYMGEDGCWYGMEIRPINEKEENMVKSLVSAGSGKVDNFTMGVLCLAILFEEVMRGKFGKKHMIAGVLFTFVLLLSGQITWRDMAHTLIMIGSNASDRMGMGVTYLALIATFKIQPFLALGFFLRKLTSRENLLLGVGLAMATTLQLPEDIEQMANGIALGLMTLKLITQFETYQLWTALVSLTCSNTIFTLTVAWRTATLILAGVSLLPLCQSSSMRKTDWLPMTVAAMGVPPLPLFIFSLKDTPKRRSWPLNEGVMAVGLVSILASSLLRNDVPMAGPLVAGGLLIACYVITGTSADLTVEKAADVTWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTHNGKRLEPNWASVKKDLISYGGGWRLSAQWQKGEEVQVIAVEPGKNPKNFQTMPGIFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLVIMDEAHFTDPASIAARGYISTRVGMGEAAAIFMTATPPGTAEAFPQSNAPIQDEERDIPERSWNSGNEWITDFVGKTVWFVPSIKAGNDIANCLRKNGKKVIQLSRKTFDTEYQKTRLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGERNNQILEENMDVEIWTKEGERKKLRPRWLDARTYSDPLALKEFKDFAAGRKSIALDLVTEIGRVPSHLAHRTRNALDNLVMLHTSEHGGRAYRHAVEELPETMETLLLLGLMISLTGGAMLFLISGKGIGKTSIGLICVIVSSGMLWMADVPLQWIASAIVLEFFMMVLLIPEPEKQRTPQDNQLAYVVIGILTLAAIVAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLVTHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGRRGTGSQGETLGEKWKKKLNQLSRKEFDLYKKSGITEVDRTEAKEGLKRGETTHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEENRTIRVLKMVEPWLRNNQFCIKVLNPYMPTVIEHLERLQRKYGGMLVRNPLSRNSTHEMYWISNGTGNIVSSVNMVSRLLLNRFTMTHRRPTIEKDVDLGAGTRHVNAEPETPNMDVIGERIKRIKEEHSSTWHYDDENPYKTWAYHGSYEVKATGSASSMINGVVKLLTKPWDVVPMVTQMAMTDTTPFGQQRVFKEKVDTRTPRPMPGTRKVMEITAEWLWRTLGRNKKPRLCTREEFTKKVRTNAAMGAVFTEENQWDSARAAVEDEEFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPKGTVMDIISRKDQRGSGQVGTYGLNTFTNMEAQLVRQMEGEGVLSKADLENPHLLEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLKETACLGKAYAQMWSLMYFHRRDLRLASNAICSAVPVHWIPTSRTTWSIHAHHQWMTTEDMLTVWNRVWIEDNPWMEDKTPVTTWEDVPYLGKREDQWCGSLIGLTSRATWAQNILTAIQQVRSLIGDEEFLDYMPSMKRFRKEEESEGAIW

SEQ ID NO: 4678 - protein, 3290 aa, Artificial Sequence
  derived and/or modified protein sequence (wt) from DENV-3__GU131938__SS-prME
TSLCLMMMLPATLAFHLTSRDGEPRMIVGKNERGKSLLFKTASGINMCTLIAMDLGEMCDDTVTYKCPLIAEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKSKPTLDIELQKTEATQLATLRKLCIEGKITNITTDSRCPTQGEATLPEEQDQNYVCKHTYVDRGWGNGCGLFGKGSLVTCAKFQCLESIEGKVVQYENLKYTVIITVHTGDQHQVGNDTQGVTVEITPQASTVEAVLPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCLNTFVLKKEVSETQHGTILIKVEYKGEDAPCKIPFSTEDGQGKAHNGRLITANPVVTKKEEPVNIEAEPPFGESNIVIGIGDKALKINWYKKGSSIGKMFEATARGARRMAILGDTAWDFGSVGGVLNSLGKMVHQIFGSAYTALFSGVSWIMKIGIGVLLTWIGLNSKNTSMSFSCIVIGIITLYLGAVVQADMGCVINWKGKELKCGNGIFVTNEVHTWTEQYKFQADSPKRLATAIAGAWENGVCGIRSTTRMENLLWKQIANELNYILWENNIKLTVVVGDIIGVLEQGKRALTPQPMELKYSWKTWGKAKIVTAETQNSSFIIDGPNTPECPSASRAWNVWEVEDYGFGVFTTNIWLKLREVYTQSCDHRLMSAAIKDERAVHADMGYWIESQKNGSWKLEKASFIEVKTCTWPKSHTLWSNGVLESDMIIPKSLAGPISQHNHRPGYHTQTAGPWHLGKLELDFNYCEGTTVVIAENCGTRGPSLRTTTVSGKLIHEWCCRSCTLPPLRYMGEDGCWYGMEIRPINEKEENMVKSLVSAGSGKVDNFTMGVLCLAILFEEVMRGKFGKKHMIAGVLFTFVLLLSGQITWRDMAHTLIMIGSNASDRMGMGVTYLALIATFKIQPFLALGFFLRKLTSRENLLLGVGLAMATTLQLPEDIEQMANGIALGLMTLKLITQFETYQLWTALVSLTCSNTIFTLTVAWRTATLILAGVSLLPLCQSSSMRKTDWLPMTVAAMGVPPLPLFIFSLKDTPKRRSWPLNEGVMAVGLVSILASSLLRNDVPMAGPLVAGGLLIACYVITGTSADLTVEKAADVTWEEEAEQTGVSHNLMITVDDDGTMKIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTHNGKRLEPNWASVKKDLISYGGGWRLSAQWQKGEEVQVIAVEPGKNPKNFQTMPGIFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLVIMDEAHFTDPASIAARGYISTRVGMGEAAAIFMTATPPGTAEAFPQSNAPIQDEERDIPERSWNSGNEWITDFVGKTVWFVPSIKAGNDIANCLRKNGKKVIQLSRKTFDTEYQKTRLNDWDFVVTTDISEMGANFKADRVIDPRRCLKPVILTDGPERVILAGPMPVTAASAAQRRGRVGRNPQKENDQYIFMGQPLNNDEDHAHWTEAKMLLDNINTPEAIIPALFEPEREKSAAIDGEYRLKGESRKTFVELMRRGDLPVWLAHKVASEGIKYTDRKWCFDGERNNQILEENMDVEIWTKEGERKKLRPRWLDARTYSDPLALKEFKDFAAGRKSIALDLVTEIGRVPSHLAHRTRNALDNLVMLHTSEHGGRAYRHAVEELPETMETLLLLGLMILLTGGAMLFLISGKGIGKTSIGLICVIVSSGMLWMADVPLQWIASAIVLEFFMMVLLIPEPEKQRTPQDNQLAYVVIGILTLAAIVAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLVTHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGRRGTGSQGETLGEKWKKKLNQLSRKEFDLYKKSGITEVDRTEAKEGLKRGETTHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLRSNQFCIKVLNPYMPTVIEHLERLQRKYGGMLVRNPLSRNSTHEMYWISNGTGNIVSSVNMVSRLLLNRFTMTHRRPTIEKDVDLGAGTRHVNAEPETPNMDVIGERIKRIKEEHSSTWHYDDENPYKTWAYHGSYEVKATGSASSMINGVVKLLTKPWDVVPMVTQMAMTDTTPFGQQRVFKEKVDTRTPRPMPGTRKVMEITAEWLWRTLGRNKKPRLCTREEFTKKVRTNAAMGAVFTEENQWDSARAAVEDEEFWKLVDKERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPKGTVMDIISRKDQRGSGQVGTYGLNTFTNMEAQLVRQMEGEGVLSKADLENPHLLEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLKETACLGKAYAQMWSLMYFHRRDLRLASNAICSAVPVHWIPTSRTTWSIHAHHQWMTTEDMLTVWNRVWIEDNPWMEDKTPVTTWEDVPYLGKREDQWCGSLIGLTSRATWAQNILTAIQQVRSLIGDEEFLDYMPSMKRFRKEEETEGAIW

SEQ ID NO: 4679 - protein, 3290 aa, Artificial Sequence
  derived and/or modified protein sequence (wt) from DENV-3__GU131939__SS-prME
TSLCLMMMLPATLAFHLTSRDGEPRMIVGKNERGKSLLFKTASGINMCTLIAMDLGEMCDDTVTYKCPLIAEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKSKPTLDIELQKTEATQLATLRKLCIEGKITNITTDSRCPTQGEATLPEEQDQNYVCKHTYVDRGWGNGCGLFGKGSLVTCAKFQCLEPIEGKVVQYENLKYTVIITVHTGDQHQVGNDTQGVTVEITPQASTVEAVLPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCLNTFVLKKEVSETQHGTILIKVEYKGEDAPCKIPFSTEDGQGKAHNGRLITANPVVTKKEEPINIEAEPPFGESNIVIGIGDKALKINWYKKGSSIGKMFEATARGARRMAILGDTAWDFGSVGGVLNSLGKMVHQIFGSAYTALFSGVSWIMKIGIGVLLTWIGLNSKNTSMSFSCIVIGIITLYLGAVVQADMGCVINWKGKELKCGNGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSASRAWNVWEVEDYGFGVFTTNIWLKLREVYTQSCDHRLMSAAIKDERAVHADMGYWIESQKNGSWKLEKASFIEVKTCTWPKSHTLWSNGVLESDMIIPKSLAGPISQHNHRPGYHTQTAGPWHLGKLELDFNYCEGTTVVIAENCGTRGPSLRTTTVSGKLIHEWCCRSCTLPPLRYMGEDGCWYGMEIRPINEKEENMVKSLVSAGSGKVDNFTMGVLCLAILFEEVMRGKFGKKHMIAGVLFTFVLLLSGQITWRDMAHTLIMIGSNASDRMGMGVTYLALIATFKIQPFLALGFFLRKLTSRENLLLGVGLAMATTLQLPEDIEQMANGIALGLMTLKLITQFETYQLWTALVSLTCSNTIFTLTVAWRTATLILAGVSLLPLCQSSSMRKTDWLPMTVAAMGVPPLPLFIFSLKDTPKRKSWPLNEGVMAVGLVSILASSLLRNDVPMAGPLVAGGLLIACYVITGTSADLTVEKAADVTWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTHNGKRLEPNWASVKKDLISYGGGWRLSAQWQKGEEVQVIAVEPGKNPKNFQTMPGIFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTAEAFPQSNAPIQDEERDIPERSWNSGNEWITDFVGKTVWFVPSIKAGNDIANCLRKNGKRVIQLSRKTFDTEYQKTRLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGERNNQILEENMDVEIWTKEGERKKLRPRWLDARTYSDPLALKEFKDFAAGRKSIALDLVTEIGRVPSHLAHRTRNALDNLVMLHTSEHGGRAYRHAVEELPETMETLLLLGLMILLTGGAMLFLISGKGIGKTSIGLICVIVSSGMLWMADVPLQWIASAIVLEFFMMVLLIPEPEKQRTPQDNQLAYVVIGILTLAAIVAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLVTHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGRRGTGSQGETLGEKWKKKLNQLSRKEFDLYKKSGITEVDRTEAKEGLKRGETTHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLRNNQFCIKVLNPYMPNVIEHLERLQRKYGGMLVRNPLSRNSTHEMYWISNGTGNIVSSVNMVSRLLLNRFTMTHRRPTIEKDVDLGAGTRHVNAEPETPNMDVIGERIKRIKEEHSSTWHYDDENPYKTWAYHGSYEVKATGSASSMINGVVKLLTKPWDVVPMVTQMAMTDTTPFGQQRVFKEKVDTRTPRPMPGTRKVMEITAEWLWRTLGRNKKPRLCTREEFTKKVRTNAAMGAVFTEENQWDSARAAVEDEEFWKLVDKERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPKGTVMDIISRKDQRGSGQVGTYGLNTFTNMEAQLVRQMEGEGVLSEADLENPHLLEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLKETACLGKAYAQMWSLMYFHRRDLRLASNAICSAVPVHWIPTSRTTWSIHAHHQWMTTEDMLTVWNRVWIEDNPWMEDKTPVTTWEDVPYLGKREDQWCGSLIGLTSRATWAQNILTAIQQVRSLIGDEEFLDYMPSMKRFRKEEESEGAIW

SEQ ID NO: 4680 - protein, 3290 aa, Artificial Sequence
  derived and/or modified protein sequence (wt) from DENV-3__GU131940__SS-prME
TSLCLMMMLPATLAFHLTSRDGEPRMIVGKNERGKSLLFKTASGINMCTLIAMDLGEMCDDTVTYKCPLIAEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKSKPTLDIELQKTEATQLATLRKLCIEGKITNITTDSRCPTQGEATLPEEQDQNYVCKHTYVDRGWGNGCGLFGKGSLVTCAKFQCLEPIEGKVVQYENLKYTVIITVHTGDQHQVGNDTQGVTVEITPQASTVEAVLPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCLNTFVLKKEVSETQHGTILIKVEYKGEDAPCKIPFSTEDGQGKAHNGRLITANPVVTKKEEPVNIEAEPPFGESNIVIGIGDKALKINWYKKGSSIGKMFEATARGARRMAILGDTAWDFGSVGGVLNSLGKMVHQIFGSAYTALFSGVSWIMKIGIGVLLTWIGLNSKNTSMSFSCIVIGIITLYLGTVVQADMGCAINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSASRAWNVWEVEDYGFGVFTTNIWLKLREVYTQSCDHRLMSAAIKDERAVHADMGYWIESQKNGSWKLEKASFIEVKTCTWPKSHTLWSNGVLESDMIIPKSLAGPISQHNHRPGYHTQTAGPWHLGKLELDFNYCEGTTVVITENCGTRGPSLRTTTVSGKLIHEWCCRSCTLPPLRYMGEDGCWYGMEIRPINEKEENMVKSLVSAGSGKVDNFTMGVLCLAILFEEVMRGKFGKKHMIAGVLFTFVLLLSGQITWRDMAHTLIMIGSNASDRMGMGVTYLALIATFKIQPFLALGFFLRKLTSRENLLLGVGLAMATTLQLPEDIEQMANGIALGLMTLKLITQFETYQLWTALVSLTCSNTIFTLTVAWRTATLILAGVSLLPLCQSSSMRKTDWLPMTVAAMGVPPLPLFIFSLKDTPKRRSWPLNEGVMAVGLVSILASSLLRNDVPMAGPLVAGGLLIACYVITGTSADLTVEKAADVTWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTHNGKRLEPNWASVKKDLISYGGGWRLNAQWQKGEEVQVIAVEPGKNPKNFQTMPGIFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLVIMDEAHFTDPASIAARGYISTRVGMGEAAAIFMTATPPGTAEAFPQSNAPIQDEERDIPERSWNSGNEWITDFVGKTVWFVPSIKAGNDIANCLRKNGKKVIQLSRKTFDTEYQKTRLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAYKVASEGIKYTDRKWCFDGERNNQILEENMDVEIWTKEGERKKLRPRWLDARTYSDPLALKEFKDFAAGRKSIALDLVTEIGRVPSHLAHRTRNALDNLVMLHTSEHGGRAYRHAVEELPETMETLLLLGLMILLTGGAMLFLISGKGIGKTSIGLICVIVSSGMLWMADVPLQWIASAIVLEFFMMVLLIPEPEKQRTPQDNQLAYVVIGILTLAAIVAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLVTHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGRRGTGSQGETLGEKWKKKLNQLSRKEFDLYKKSGITEVDRTEAKEGLKRGETTHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLRNNQFCIKVLNPYMPTVIEHLERLQRKYGGMLVRNPLSRNSTHEMYWISNGTGNIVSSVNMVSRLLLNRFTMTHRRPTIEKDVDLGAGTRHVNAEPETPNMDVIGERIKRIKEEHSSTWHYDDENPYKTWAYHGSYEVKATGSASSMINGVVKLLTKPWDVVPMVTQMAMTDTTPFGQQRVFKEKVDTRTPRPMPGTRKVMEITAEWLWRTLGRNKKPRLCTREEFTKKVRTNAAMGAVFTEENQWDSARAAVEDEEFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPKGTVMDIISRKDQRGSGQVGTYGLNTFTNMEAQLVRQMEGEGVLSKADLENPHLLEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLKETACLGKAYAQMWSLMYFHRRDLRLASNAICSAVPVHWIPTSRTTWSIHAHHQWMTTEDMLTVWNRVWIEDNPWMEDKTPVTTWEDVPYLGKREDQWCGSLIGLTSRATWAQNILTAIQQVRSLIGDEEFLDYMPSMKRFRKEEESEGAIW

SEQ ID NO: 4681 - protein, 3290 aa, Artificial Sequence
  derived and/or modified protein sequence (wt) from DENV-3__GU131942__SS-prME
TSLCLMMMFPATLAFHLTSRDGEPRMIVGKNERGKSLLFKTASGINMCTLIAMDLGEMCDDTVTYKCPLIAEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKSKPTLDIELQKTEATQLATLRKLCIEGKITNITTDSRCPTQGEATLPEEQDQNYVCKHTYVDRGWGNGCGLFGKGSLVTCAKFQCLEPIEGKVVQYENLKYTVIITVHTGDQHQVGNDTQGVTVEITPQASTVEAVLPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCLNTFVLKKEVSETQHGTILIKVEYKGEDAPCKIPFSTEDGQGKAHSGRLITANPVVTKKEEPVNIEAEPPFGESNIVIGIGDKALKINWYKKGSSIGKMFEATARGARRMAILGDTAWDFGSVGGVLNSLGKMVHQIFGSAYTALFSGVSWVMKIGIGVLLTWIGLNSKNTSMSFSCIVIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSASRAWNVWEVEDYGFGVFTTNIWLKLREVYTQSCDHRLMSAAIKDERAVHADMGYWIESQKNGSWKLEKASFIEVKTCTWPKSHTLWSNGVLESDMIIPKSLAGPISQHNHRPGYHTQTAGPWHLGKLELDFNYCEGTTVVITENCGTRGPSLRTTTVSGKLIHEWCCRSCTLPPLRYMGEDGCWYGMEIRPINEKEENMVKSLVSAGSGKVDNFTMGVLCLAILFEEVMRGKFGKKHMIAGVLFTFVLLLSGQITWRDMAHTLIMIGSNASDRMGMGVTYLALIATFKIQPFLALGFFLRKLTSRENLLLGVGLAMATTLQLPEDIEQMANGIALGLMTLKLITQFETYQLWTALVSLTCSNTVFTLTVAWRTATLILAGVSLLPLCQSSSMRKTDWLPMTVAAMGVPPLPLFIFSLKDTPKRRSWPLNEGVMAVGLVSILASSLLRNDVPMAGPLVAGGLLIACYVITGTSADLTVEKAADVTWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTHNGKRLEPNWASVKKDLISYGGGWRLNAQWQKGEEVQVIAVEPGKNPKNFQTMPGIFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLVIMDEAHFTDPASIAARGYISTRVGMGEAAAIFMTATPPGTAEAFPQSNAPIQDEERDIPERSWNSGNEWITDFVGKTVWFVPSIKAGNDIANCLRKNGKKVIQLSRKTFDTEYQKTRLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGERNNQILEENMDVEIWTKEGERKKLRPRWLDARTYSDPLALKEFKDFAAGRKSIALDLVTEIGRVPSHLAHRTRNALDNLVMLHTSEHGGRAYRHAVEELPETMETLLLLGLMILLTGGAMLFLISGKGIGKTSIGLICVIVSSGMLWMADVPLQWIASAIVLEFFMMVLLIPEPEKQRTPQDNQLAYVVIGILTLAAIVAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLVTHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGAGRRGTGSQGETLGEKWKKKLNQLSRKEFDLYKKSGITEVDRTEAKEGLKRGETTHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLRNNQFCIKVLNPYMPTVIEHLERLQRKYGGMLVRNPLSRNSTHEMYWISNGTGNIVSSVNMVSRLLLNRFTMTHRRPTIEKDVDLGAGTRHVNAEPETPNMDVIGERIKRIKEEHSSTWHYDDENPYKTWAYHGSYEVKATGSASSMINGVVKLLTKPWDVVPMVTQMAMTDTTPFGQQRVFKEKVDTRTPRPMPGTRKVMEITAEWLWRTLGRNKKPRLCTREEFTKKVRTNAAMGAVFTEENQWDSARAAVEDEEFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPKGTVMDIISRKDQRGSGQVGTYGLNTFTNMEAQLVRQMEGEGVLSKADLENPHLLEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLKETACLGKAYAQMWSLMYFHRRDLRLASNAICSAVPVHWIPTSRTTWSIHAHHQWMTTEDMLTVWNRVWIEDNPWMEDKTPVTTWEDVPYLGKREDQWCGSLIGLTSRATWAQNILTAIQQVRSLIGDEEFLDYMPSMKRFRKEEESEGAIW

SEQ ID NO: 4682 - protein, 3290 aa, Artificial Sequence
  derived and/or modified protein sequence (wt) from DENV-3__GU131943__SS-prME
TSLCLMMMLPATLAFHLTSRDGEPRMIVGKNERGKSLLFKTASGINMCTLIAMDLGEMCDDTVTYKCPLIAEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKSKPTLDIELQKTEATQLATLRKLCIEGKITNITTDSRCPTQGEATLPEEQDQNYVCKHTYVDRGWGNGCGLFGKGSLVTCAKFQCLEPIEGKVVQYENLKYTVIITVHTGDQHQVGNDTQGVTVEITPQASTVEAVLPEYGTLGLECSPRTGLDFNEMILLTMKNKAWMVHRQWFFDLPLPWTSGATTETPIWNRKELLVTFKNAHAKKQEVVVLGSQEGAMHTALTGATEIQNSGGTSIFAGHLKCRLKMDKLELKGMSYAMCLNTFVLKKEVSETQHGTILIKVEYKGEDAPCKIPFSTEDGQGKAHNGRLITANPVVTKKEEPVNIEAEPPFGESNIVIGIGDKALKINWYKKGSSIGKMFEATARGARRMAILGDTAWDFGSVGGVLNSLGKMVHQIFGSAYTALFSGVSWIMKIGIGVLLTWIGLNSKNTSMSFSCIVIGIITLYLGAVVQADMGCAINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSASRAWNVWEVEDYGFGVFTTNIWLKLREVYTQSCDHRLMSAAIKDERAVHADMGYWIESQKNGSWKLEKASFIEVKTCTWPKSHTLWSNGVLESDMIIPKSLAGPISQHNHRPGYHTQTAGPWHLGKLELDFNYCEGTTVVITENCGTRGPSLRTTTVSGKLIHEWCCRSCTLPPLRYMGEDGCWYGMEIRPINEKEENMVKSLVSAGSGKVDNFTMGVLCLAILFEEVMRGKFGKKHMIAGVLFTFVLLLSGQITWRDMAHTLIMIGSNASDRMGMGVTYLALIATFKIQPFLALGFFLRKLTSRENLLLGVGLAMATTLQLPEDIEQMANGIALGLMTLKLITQFETYQLWAALVSLTCSNTIFTLTVAWRTATLILAGVSLLPLCQSSSMRKTDWLPMTVAAMGVPPLPLFIFSLKDTPKRRSWPLNEGVMAVGLVSILASSLLRNDVPMAGPLVAGGLLIACYVITGTSADLTVEKAADVTWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTHNGKRLEPNWASVKKDLISYGGGWRLNAQWQKGEEVQVIAVEPGKNPKNFQTMPGIFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLVIMDEAHFTDPASIAARGYISTRVGMGEAAAIFMTATPPGTAEAFPQSNAPIQDEERDIPERSWNSGNEWITDFVGKTVWFVPSIKAGNDIANCLRKNGKKVIQLSRKTFDTEYQKTRLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGERNNQILEENMDVEIWTKEGERKKLRPRWLDARTYSDPLALKEFKDFAAGRKSIALDLVTEIGRVPSHLAHRTRNALDNLVMLHTSEHGGRAYRHAVEELPETMETLLLLGLMILLTGGAMLFLISGKGIGKTSIGLICVIVSSGMLWMADVPLQWIASAIVLEFFMMVLLIPEPEKQRTPQDNQLAYVVIGILTLAAIVAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLVTHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGRRGTGSQGETLGEKWKKKLNQLSRKEFDLYKKSGITEVDRTEAKEGLKRGETTHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLRNNQFCIKVLNPYMPTVIEHLERLQRKYGGMLVRNPLSRNSTHEMYWISNGTGNIVSSVNMVSRLLLNRFTMTHRRPTIEKDVDLGAGTRHVNAEPETPNMDVIGERIKRIKEEHSSTWHYDDENPYKTWAYHGSYEVKATGSASSMINGVVKLLTKPWDVVPMVTQMAMTDTTPFGQQRVFKEKVDTRTPRPMPGTRKVMEITAEWLWRTLGRNKKPRLCTREEFTKKVRTNAAMGAVFTEENQWDSARAAVEDEEFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPKGTVMDIISRKDQRGSGQVGTYGLNTFTNMEAQLVRQMEGEGVLSKADLENPHLLEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLKETACLGKAYAQMWSLMYFHRRDLRLASNAICSAVPVHWIPTSRTTWSIHAHHQWMTTEDMLTVWNRVWIEDNPWMEDKTPVTTWEDVPYLGKREDQWCGSLIGLTSRATWAQNILTAIQQVRSLIGDEEFLDYMPSMKRFRKEEESEGAIW

SEQ ID NO: 4683 - protein, 3290 aa, Artificial Sequence
  derived and/or modified protein sequence (wt) from DENV-3__GU131945__SS-prME
TSLCLMMMLPATLAFHLTSRDGEPRMIVGKNERGKSLLFKTASGINMCTLIAMDLGEMCDDTVTYKCPLIAEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKSKPTLDIELQKTEATQLATLRKLCIEGKITNITTDSRCPTQGEATLPEEQDQNYVCKHTYVDRGWGNGCGLFGKGSLVTCAKFQCLESIEGKVVQYENLKYTVIITVHTGDQHQVGNDTQGVTVEITPQASTVEAVLPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCLNTFVLKKEVSETQHGTILIKVEYKGEDAPCKIPFSTEDGQGKAHNGRLITANPVVTKKEEPVNIEAEPPFGESNIVIGIGDKALKINWYKKGSSIGKMFEATARGARRMAILGDTAWDFGSVGGVLNSLGKMVHQIFGSAYTALFSGVSWIMKIGIGVLLTWIGLNSKNTSMSFSCIVIGIITLYLGAVVQADMGCVINWKGKELKCGNGIFVTNEVHTWTEQYKFQADSPKRLATAIAGAWENGVCGIRSTTRMENLLWKQIANELNYILWENNIKLTVVVGDIIGVLEQGKRALTPQPMELKYSWKTWGKAKIVTAETQNSSFIIDGPNTPECPSASRAWNVWEVEDYGFGVFTTNIWLKLREVYTQSCDHRLMSAAIKDERAVHADMGYWIESQKNGSWKLEKASFIEVKTCTWPKSHTLWSNGVLESDMIIPKSLAGPISQHNHRPGYHTQTAGPWHLGKLELDFNYCEGTTVVIAENCGTRGPSLRTTTVSGKLIHEWCCRSCTLPPLRYMGEDGCWYGMEIRPINEKEENMVKSLVSAGSGKVDNFTMGVLCLAILFEEVMRGKFGKKHMIAGVLFTFVLLLSGQITWRDMAHTLIMIGSNASDRMGMGVTYLALIATFKIQPFLALGFFLRKLTSRENLLLGVGLAMATTLQLPEDIEQMANGIALGLMTLKLITQFETYQLWTALVSLTCSNTIFTLTVAWRTATLILAGVSLLPLCQSSSMRKTDWLPMTVAAMGVPPLPLFIFSLKDTPKRRSWPLNEGVMAVGLVSILASSLLRNDVPMAGPLVAGGLLIACYVITGTSADLTVEKAADVTWEEEAEQTGVSHNLMITVDDDGTMKIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTHNGKRLEPNWASVKKDLISYGGGWRLSAQWQKGEEVQVIAVEPGKNPKNFQTMPGIFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLVIMDEAHFTDPASIAARGYISTRVGMGEAAAIFMTATPPGTAEAFPQSNAPIQDEERDIPERSWNSGNEWITDFVGKTVWFVPSIKAGNDIANCLRKNGKKVIQLSRKTFDTEYQKTRLNDWDFVVTTDISEMGANFKADRVIDPRRCLKPVILTDGPERVILAGPMPVTAASAAQRRGRVGRNPQKENDQYIFMGQPLNNDEDHAHWTEAKMLLDNINTPEGIIPALFEPEREKSAAIDGEYRLKGESRKTFVELMRRGDLPVWLAHKVASEGIKYTDRKWCFDGERNNQILEENMDVEIWTKEGERKKLRPRWLDARTYSDPLALKEFKDFAAGRKSIALDLVTEIGRVPSHLAHRTRNALDNLVMLHTSEHGGRAYRHAVEELPETMETLLLLGLMILLTGGAMLFLISGKGIGKTSIGLICVIVSSGMLWMADVPLQWIASAIVLEFFMMVLLIPEPEKQRTPQDNQLAYVVIGILTLAAIVAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLVTHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGRRGTGSQGETLGEKWKKKLNQLSRKEFDLYKKSGITEVDRTEAKEGLKRGETTHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLRSNQFCIKVLNPYMPTVIEYLERLQRKYGGMLVRNPLSRNSTHEMYWISNGTGNIVSSVNMVSRLLLNRFTMTHRRPTIEKDVDLGAGTRHVNAEPETPNMDVIGERIKRIKEEHSSTWHYDDENPYKTWAYHGSYEVKATGSASSMINGVVKLLTKPWDVVPMVTQMAMTDTTPFGQQRVFKEKVDTRTPRPMPGTRKVMEITAEWLWRTLGRNKKPRLCTREEFTKKVRTNAAMGAVFTEENQWDSARAAVEDEEFWKLVDKERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPKGTVMDIISRKDQRGSGQVGTYGLNTFTNMEAQLVRQMEGEGVLSKADLENPHLLEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLKETACLGKAYAQMWSLMYFHRRDLRLASNAICSAVPVHWIPTSRTTWSIHAHHQWMTTEDMLTVWNRVWIEDNPWMEDKTPVTTWEDVPYLGKREDQWCGSLIGLTSRATWAQNILTAIQQVRSLIGDEEFLDYMPSMKRFRKEEETEGAIW

SEQ ID NO: 4684 - protein, 3290 aa, Artificial Sequence
  derived and/or modified protein sequence (wt) from DENV-3__GU131946__SS-prME
TSLCLMMMLPATLAFHLTSRDGEPRMIVGKNERGKSLLFKTASGINMCTLIAMDLGEMCDDTVTYKCPLIAEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKSKPTLDIELQKTEATQLATLRKLCIEGKITNITTDSRCPTQGEATLPEEQDQNYVCKHTYVDRGWGNGCGLFGKGSLVTCAKFQCLEPIEGKVVQYENLKYTVIITVHTGDQHQVGNDTQGVTVEITPQASTVEAVLPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCLNTFVLKKEVSETQHGTILIKVEYKGEDAPCKIPFSTEDGQGKAHNGRLITANPVVTKKEEPVNIEAEPPFGESNIVIGIGDKALKINWYKKGSSIGKMFEATARGARRMAILGDTAWDFGSVGGILNSLGKMVHQIFGSAYTALFSGVSWIMKIGIGVLLTWIGLNSKNTSMSFSCIVIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKARIVTAETQNSSFIIDGPNTPECPSASRAWNVWEVEDYGFGVFTTNIWLKLREVYTQSCDHRLMSAAIKDERAVHADMGYWIESQKNGSWKLEKASFIEVKTCTWPKSHTLWSNGVLESDMIIPKSLAGPISQHNHRPGYHTQTAGPWHLGKLELDFNYCEGTTVVITENCGTRGPSLRTTTVSGKLIHEWCCRSCTLPPLRYMGEDGCWYGMEIRPINEKEENMVKSLVSAGSGKVDNFTMGVLCLAILFEEVMRGKFGKKHMIAGVLFTFVLLLSGQITWRDMAHTLIMIGSNASDRMGMGVTYLALIATFKIQPFLALGFFLRKLTSRENLLLGVGLAMATTLQLPEDIEQMANGIALGLMTLKLITQFETYQLWTALVSLTCSNTIFTLTVAWRTATLILAGVSLLPLCQSSSMRKTDWLPMTVAAMGVPPLPLFIFSLKDTPKRRSWPLNEGVMAVGLVSILASSLLRNDVPMAGPLVAGGLLIACYVITGTSADLTVEKAADVTWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTHNGKRLEPNWASVKKDLISYGGGWRLSAQWQKGEEVQVIAVEPGKNPKNFQTMPGIFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLVIMDEAHFTDPASIAARGYISTRVGMGEAAAIFMTATPPGTAEAFPQSNAPIQDEERDIPERSWNSGNEWITDFVGKTVWFVPSIKAGNDIANCLRKNGKKVIQLSRKTFDTEYQKTRLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFLELMRRGDLPVWLAHKVASEGIKYTDRKWCFDGERNNQILEENMDVEIWTKEGERKKLRPRWLDARTYSDPLALKEFKDFAAGRKSIALDLVTEIGRVPSHLAHRTRSALDNLVMLHTSEHGGRAYRHAVEELPETMETLLLLGLMILLTGGAMLFLISGKGIGKTSIGLICVIVSSGMLWMADVPLQWIASAIVLEFFMMVLLIPEPEKQRTPQDNQLAYVVIGILTLAAIVAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLVTHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGRRGTGSQGETLGEKWKKKLNQLSRKEFDLYKKSGITEVDRTEAKEGLKRGETTHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLRNNQFCIKVLNPYMPTVIEHLERLQRKYGGMLVRNPLSRNSTHEMYWISNGTGNIVSSVNMVSRLLLNRFTMTHRRPTIEKDVDLGAGTRHVNAEPETPNMDVIGERIKRIKEEHSSTWHYDDENPYKTWAYHGSYEVKATGSASSMINGVVKLLTKPWDVVPMVTQMAMTDTTPFGQQRVFKEKVDTRTPRPMPGTRKVMEITAEWLWRTLGRNKKPRLCTREEFTKKVRTNAAMGAVFTEENQWDNARAAVEDEEFWKLVDRERELHKLGKCGSCIYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPKGTVMDIISRKDQRGSGQVGTYGLNTFTNMEAQLVRQMEGEGVLSKADLENPHLLEKKITQWLETKGVDRLKRMAISGDDCVVKPIDDRFANALLALNDMGKVRKDIPQWQPSKGWHDWQQVPFCSHHFHELIMKDGRKLVVPCRPQDELIGRARISQGAGWSLKETACLGKAYAQMWSLMYFHRRDLRLASNAICSAVPVHWIPTSRTTWSIHAHHQWMTTEDMLTVWNRVWIEDNPWMEDKTPVTTWEDVPYLGKREDQWCGSLIGLTSRATWAQNILTAIQQVRSLIGDEEFLDYMPSMKRFRKEEESEGAIW

SEQ ID NO: 4685 - protein, 3290 aa, Artificial Sequence
  derived and/or modified protein sequence (wt) from DENV-3__FJ639712__SS-prME
TSLCLMMMFPATLAFHLTSRDGEPRMIVGKNERGKSLLFKTASGINMCTLIAMDLGEMCDDTVTYKCPLIAEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKSKPTLDIELQKTEATQLATLRKLCIEGKITNITTDSRCPTQGEATLPEEQDQNYVCKHTYVDRGWGNGCGLFGKGSLVTCAKFQCLEPIEGKVVQYENLKYTVIITVHTGDQHQVGNDTQGVTVEITPQASTVEAVLPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCLNTFVLKKEVSETQHGTILIKVEYKGEDAPCKIPFSTEDGQGKAHSGRLITANPVVTKKEEPVNIEAEPPFGESNIVIGIGDKALKINWYKKGSSIGKMFEATARGARRMAILGDTAWDFGSVGGVLNSLGKMVHQIFGSAYTALFSGVSWVMKIGIGVLLTWIGLNSKNTSMSFSCIVIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSASRAWNVWEVEDYGFGVFTTNIWLKLREVYTQSCDHRLMSAAIKDERAVHADMGYWIESQKNGSWKLEKASFIEVKTCTWPKSHTLWSNGVLESDMIIPKSLAGPISQHNHRPGYHTQTAGPWHLGKLELDFNYCEGTTVVITENCGTRGPSLRTTTVSGKLIHEWCCRSCTLPPLRYMGEDGCWYGMEIRPINEKEENMVKSLVSAGSGKVDNFTMGVLCLAILFEEVMRGKFGKKHMIAGVLFTFVLLLSGQITWRDMAHTLIMIGSNASDRMGMGVTYLALIATFKIQPFLALGFFLRKLTSRENLLLGVGLAMATTLQLPEDIEQMANGIALGLMTLKLITQFETYQLWTALVSLTCSNTIFTLTVAWRTATLILAGVSLLPLCQSSSMRKTDWLPMTVAAMGVPPLPLFIFSLKDTPKRRSWPLNEGVMAVGLVSILASSLLRNDVPMAGPLVAGGLLIACYVITGTSADLTVEKAADVTWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTHNGKRLEPNWASVKKDLISYGGGWRLNAQWQKGEEVQVIAVEPGKNPKNFQTMPGIFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLVIMDEAHFTDPASIAARGYISTRVGMGEAAAIFMTATPPGTAEAFPQSNAPIQDEERDIPERSWNSGNEWITDFVGKTVWFVPSIKAGNDIANCLRKNGKKVIQLSRKTFDTEYQKTRLNEWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYADRKWCFDGERNNQILEENMDVEIWTKEGERKKLRPRWLDARTYSDPLALKEFKDFAAGRKSIALDLVTEIGRVPSHLAHRTRNALDNLVMLHTSEHGGRAYRHAVEELPETMETLLLLGLMILLTGGAMLFLISGKGIGKTSIGLICVIVSSGMLWMADVPLQWIASAIVLEFFMMVLLIPEPEKQRTPQDNQLAYVVIGILTLAAIVAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLVTHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGRRGTGSQGETLGEKWKKKLNQLSRKEFDLYKKSGITEVDRTEAKEGLKRGETTHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLRNNQFCIKVLNPYMPTVIEHLERLQRKYGGMLVRNPLSRNSTHEMYWISNGTGNIVSSVNMVSRLLLNRFTMTHRRPTIEKDVDLGAGTRHVNAEPETPNMDVIGERIKRIKEEHSSTWHYDDENPYKTWAYHGSYEVKATGSASSMINGVVKLLTKPWDVVPMVTQMAMTDTTPFGQQRVFKEKVDTRTPRPMPGTRKVMEITAEWLWRTLGRNKKPRLCTREEFTKKVRTNAAMGAVFTEENQWDSARAAVEDEEFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPKGTVMDIISRKDQRGSGQVGTYGLNTFTNMEAQLVRQMEGEGVLSKADLENPHLLEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLKETACLGKAYAQMWSLMYFHRRDLRLASNAICSAVPVHWIPTSRTTWSIHAHHQWMTTEDMLTVWNRVWIEDNPWMEDKTPVTTWEDVPYLGKREDQWCGSLIGLTSRATWAQNILTAIQQVRSLIGDEEFLDYMPSMKRFRKEEESEGAIW

SEQ ID NO: 4686 - protein, 3290 aa, Artificial Sequence
  derived and/or modified protein sequence (wt) from DENV-3__FJ639713__SS-prME
TSLCLMMMLPATLAFHLTSRDGEPRMIVGKNERGKSLLFKTASGINMCTLIAMDLGEMCDDTVTYKCPLIAEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKSKPTLDIELQKTEATQLATLRKLCIEGKITNITTDSRCPTQGEATLPEEQDQNYVCKHTYVDRGWGNGCGLFGKGSLVTCAKFQCLEPIEGKVVQYENLKYTVIITVHTGDQHQVGNDTQGVTVEITPQASTVEAVLPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCLNTFVLKKEVSETQHGTILIKVEYKGEDAPCKIPFSTEDGQGKAHNGRLITANPVVTKKEEPVNIEAEPPFGESNIVIGIGDKALKINWYKKGSSIGKMFEATARGARRMAILGDTAWDFGSVGGVLNSLGKMVHQIFGSAYTALFSGVSWIMKIGIGVLLTWIGLNSKNTSMSFSCIVIGIITLYLGAVVQADMGCVINWKGKELKCGNGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSASRAWNVWEVEDYGFGVFTTNIWLKLREVYTQSCDHRLMSAAIKDERAVHADMGYWIESQKNGSWKLEKASFIEVKTCTWPKSHTLWSNGVLESDMIIPKSLAGPISQHNHRPGYHTQTAGPWHLGKLELDFNYCEGTTVVIAENCGTRGPSLRTTTVSGKLIHEWCCRSCTLPPLRYMGEDGCWYGMEIRPINEKEENMVKSLVSAGSGKVDNFTMGVLCLAILFEEVMRGKFGKKHMIAGVLFTFVLLLSGQITWRDMAHTLIMIGSNASDRMGMGVTYLALIATFKIQPFLALGFFLRKLTSRENLLLGVGLAMATTLQLPEDIEQMANGIALGLMTLKLITQFETYQLWTALVSLTCSNTIFTLTVAWRTATLILAGVSLLPLCQSSSMRKTDWLPMTVAAMGVPPLPLFIFSLKDTPKRRSWPLNEGVMAVGLVSILASSLLRNDVPMAGPLVAGGLLIACYVITGTSADLTVEKAADVTWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTHNGKRLEPNWASVKKDLISYGGGWRLSAQWQKGEEVQVIAVEPGKNPKNFQTMPGIFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLVIMDEAHFTDPASIAARGYISTRVGMGEAAAIFMTATPPGTAEAFPQSNAPIQDEERDIPERSWNSGNEWITDFVGKTVWFVPSIKAGNDIANCLRKNGKKVIQLSRKTFDTEYQKTRLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGERNNQILEENMDVEIWTKEGERKKLRPRWLDARTYSDPLALKEFKDFAAGRKSIALDLVTEIGRVPSHLAHRTRNALDNLVMLHTSEHGGRAYRHAVEELPETMETLLLLGLMILLTGGAMLFLISGKGIGKTSIGLICVIVSSGMLWMADVPLQWIASAIVLEFFMMVLLIPEPEKQRTPQDNQLAYVVIGILTLAAIVAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLVTHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGRRGTGSQGETLGEKWKKKLNQLSRKEFDLYKKSGITEVDRSEAKEGLKRGETTHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLRNNQFCIKVLNPYMPTVIEHLERLQRKHGGMLVRNPLSRNSTHEMYWISNGTGNIVSSVNMVSRLLLNRFTMTHRRPTIEKDVDLGAGTRHVNAEPETPNMDVIGERIKRIKEEHSSTWHYDDENPYKTWAYHGSYEVKATGSASSMINGVVKLLTKPWDVVPMVTQMAMTDTTPFGQQRVFKEKVDTRTPRPMPGTRKVMEITAEWLWRTLGRNKKPRLCTREEFTKKVRTNAAMGAVFTEENQWDSARAAVEDEEFWKLVDKERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPKGTVMDIISRKDQRGSGQVGTYGLNTFTNMEAQLVRQMEGEGVLSKADLENPHLLEKKIIQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLKETACLGKAYAQMWSLMYFHRRDLRLASNAICSAVPVHWIPTSRTTWSIHAHHQWMTTEDMLSVWNRVWIEDNPWMEDKTPVTTWEDVPYLGKREDQWCGSLIGLTSRATWAQNILTAIQQVRSLIGDEEFLDYMPSMKRFRKEEESEGAIW

SEQ ID NO: 4687 - protein, 3290 aa, Artificial Sequence
  derived and/or modified protein sequence (wt) from DENV-3__FJ639714__SS-prME
TSLCLMMMLPATLAFHLTSRDGEPRMIVGKNERGKSLLFKTASGINMCTLIAMDLGEMCDDTVTYKCPLIAEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKSKPTLDIELQKTEATQLATLRKLCIEGKITNITTDSRCPTQGEATLPEEQDQNYVCKHTYVDRGWGNGCGLFGKGSLVTCAKFQCLEPIEGKVVQYENLKYTVIITVHTGDQHQVGNDTQGVTVEITPQASTVEAVLPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCLNTFVLKKEVSETQHGTILIKVEYKGEDAPCKIPFSTEDGQGKAHNGRLITANPVVTKKEEPVNIEAEPPFGESNIVIGIGDKALKINWYKKGSSIGKMFEATARGARRMAILGDTAWDFGSVGGVLNSLGKMVHQIFGSAYTALFSGVSWIMKIGIGVLLTWIGLNSKNTSMSFSCIVIGIITLYLGAVVQADMGCVINWKGKELKCGNGIFVTNEVHTWTEQYKFQADSPKRLATAIAGAWESGVCGIRSTTRMENLLWKQIANELNYILWENNIKLTVVVGDIIGVLEQGKRTLTPQPMELKYSWKTWGKAKIVTAETQNSSFIIDGPNTPECPSASRAWNVWEVEDYGFGVFTTNIWLKLREVYTQSCDHRLMSAAIKDERAVHADMGYWIESQKNGSWKLEKASFIEVKTCTWPKSHTLWSNGVLESDMIIPKSLAGPISQHNHRPGYHTQTAGPWHLGKLELDFNYCEGTTVVIAENCGTRGPSLRTTTVSGKLIHEWCCRSCTLPPLRYMGEDGCWYGMEIRPINEKEENMVKSLVSAGSGKVDNFTMGVLCLAILFEEVMRGKFGKKHMIAGVLFTFVLLLSGQITWRDMAHTLIMIGSNASDRMGMGVTYLALIATFKIQPFLALGFFLRKLTSRENLLLGVGLAMATTLQLPEDIEQMANGIALGLMTLKLITQFETYQLWTALVSLTCSNTIFTLTVAWRTATLILAGVSLLPLCQSSSMRKTDWLPMTVAAMGVPPLPLFIFSLKDTPKRRSWPLNEGVMAVGLVSILASSLLRNDVPMAGPLVAGGLLIACYVITGTSADLTVEKAADVTWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTHNGKRLEPNWASVKKDLISYGGGWRLSAQWQKGEEVQVIAVEPGKNPKNFQTMPGIFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLVIMDEAHFTDPASIAARGYISTRVGMGEAAAIFMTATPPGTAEAFPQSNAPIQDEERDIPERSWNSGNEWITDFVGKTVWFVPSIKAGNDIANCLRKNGKKVIQLSRKTFDTEYQKTRLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGERNNQILEENMDVEIWTKEGERKKLRPRWLDARTYSDPLALKEFKDFAAGRKSIALDLVTEIGRVPSHLAHRTRNALDNLVMLHTSEHGGRAYRHAVEELPETMETLLLLGLMILLTGGAMLFLISGKGIGKTSIGLICVIVSSGMLWMADVPLQWIASAIVLEFFMMVLLIPEPEKQRTPQDNQLAYVVIGILTLAAIVAANEMGLLETTKRDLGMSKEPGVVSPTSYLDVDLHPASAWTLYAVATTIITPMLRHTIENSTANVSLAAIANQAVVLMGLDKGWPISKMDLGVPLLALGCYSQVNPLTLTAAVLLLVTHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGRRGTGSQGETLGEKWKKKLNQLSRKEFDLYKKSGITEVDRTEAKEGLKRGETTHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLRNNQFCIKVLNPYMPTVIEHLERLQRKYGGMLVRNPLSRNSTHEMYWISNGTGNIVSSVNMVSRLLLNRFTMTHRRPTIEKDVDLGAGTRHVNAEPETPNMDVIGERIKRIKEEHSSTWHYDDENPYKTWAYHGSYEVKATGSASSMINGVVKLLTKPWDVVPMVTQMAMTDTTPFGQQRVFKEKVDTRTPRPMPGTRKVMEITAEWLWRTLGRNKKPRLCTREEFTKKVRTNAAMGAVFTEENQWDSARAAVEDEEFWKLVDKERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPGHRQLANAIFKLTYQNKVVKVQRPTPKGTVMDIISRKDQRGSGQVGTYGLNTFTNMEAQLVRQMEGEGVLSKADLENPHLLEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLKETACLGKAYAQMWSLMYFHRRDLRLASNAICSAVPVHWIPTSRTTWSIHAHHQWMTTEDMLTVWNRVWIEDNPWMEDKTPVTTWEDVPYLGKREDQWCGSLIGLTSRATWAQNILTAIQQVRSLIGDEEFLDYMPSMKRFRKEEETEGAIW

SEQ ID NO: 4688 - protein, 3290 aa, Artificial Sequence
  derived and/or modified protein sequence (wt) from DENV-3__FJ639715__SS-prME
TSLCLMMMLPATLAFHLTSRDGEPRMIVGKNERGKSLLFKTASGINMCTLIAMDLGEMCDDTVTYKCPLIAEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKSKPTLDIELQKTEATQLATLRKLCIEGKITNITTDSRCPTQGEATLPEEQDQNYVCKHTYVDRGWGNGCGLFGKGSLVTCAKFQCLEPIEGKVVQYENLKYTVIITVHTGDQHQVGNDTQGVTVEITPQASTVEAVLPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTNIFAGHLKCRLKMDKLELKGMSYAMCLNTFVLKKEVSETQHGTILIKVEYKGEDAPCKIPFSTEDGQGKAHNGRLITANPVVTKKEEPINIEAEPPFGESNIVIGIGDKALKINWYKKGSSIGKMFEATARGARRMAILGDTAWDFGSVGGVLNSLGKMVHQIFGSAYTALFSGVSWIMKIGIGVLLTWIGLNSKNTSMSFSCIVIGIITLYLGAVVQADMGCVINWKGKELKCGNGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSASRAWNVWEVEDYGFGVFTTNIWLKLREVYTQSCDHRLMSAAIKDERAVHADMGYWIESQKNGSWKLEKASFIEVKTCTWPKSHTLWSNGVLESDMIIPKSLAGPISQHNHRPGYHTQTAGPWHLGKLELDFNYCEGTTVVIAENCGTRGPSLRTTTVSGKLIHEWCCRSCTLPPLRYMGEDGCWYGMEIRPINEKEENMVKSLVSAGSGKVDNFTMGVLCLAILFEEVMRGKFGKKHMIAGVLFTFVLLLSGQITWRDMAHTLIMIGSNASDRMGMGVTYLALIATFKIQPFLALGFFLRKLTSRENLLLGVGLAMATTLQLPEDIEQMANGIALGLMTLKLITQFETYQLWTALVSLTCSNTIFTLTVAWRTATLILAGVSLLPLCQSSSMRKTDWLPMTVAAMGVPPLPLFIFSLKDTPKRKSWPLNEGVMAVGLVSILASSLLRNDVPMAGPLVAGGLLIACYVITGTSADLTVEKAADVTWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTHNGKRLEPNWASVKKDLISYGGGWRLSAQWQKGEEVQVIAVEPGKNPKNFQTMPGIFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTAEAFPQSNAPIQDEERDIPERSWNSGNEWITDFVGKTVWFVPSIKAGNDIANCLRKNGKKVIQLSRKTFDTEYQKTRLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGERNNQILEENMDVEIWTKEGERKKLRPRWLDARTYSDPLALKEFKDFAAGRKSIALDLVTEIGRVPSHLAHRTRNALDNLVMLHTSEHGGRAYRHAVEELPETMETLLLLGLMILLTGGAMLFLISGKGIGKTSIGLICVIVSSGMLWMADVPLQWIASAIVLEFFMMVLLIPEPEKQRTPQDNQLAYVVIGILTLAAIVAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLVTHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGRRGTGSQGETLGEKWKKKLNQLSRKEFDLYKKSGITEVDRTEAKEGLKRGETTHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLRNNQFCIKVLNPYMPNVIEHLERLQRKYGGMLVRNPLSRNSTHEMYWISNGTGNIVSSVNMVSRLLLNRFTMTHRRPTIEKDVDLGAGTRHVNAEPETPNMDVIGERIKRIKEEHSSTWHYDDENPYKTWAYHGSYEVKATGSASSMINGVVKLLTKPWDVVPMVTQMAMTDTTPFGQQRVFKEKVDTRTPRPMPGTRKVMEITAEWLWRTLGRNKKPRLCTREEFTKKVRTNAAMGAVFTEENQWDSARAAVEDEEFWKLVDKERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPKGTVMDIISRKDQRGSGQVGTYGLNTFTNMEAQLVRQMEGEGVLSEADLENPHLLEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLKETACLGKAYAQMWSLMYFHRRDLRLASNAICSAVPVHWIPTSRTTWSIHAHHQWMTTEDMLTVWNRVWIEDNPWMEDKTPVTTWEDVPYLGKREDQWCGSLIGLTSRATWAQNILTAIQQVRSLIGDEEFLDYMPSMKRFRKEEESEGAIW

SEQ ID NO: 4689 - protein, 3290 aa, Artificial Sequence
  derived and/or modified protein sequence (wt) from DENV-3__KF955461__SS-prME
TSLCLMMMLPATLAFHLTSRDGEPRMIVGKNERGKSLLFKTASGINMCTLIAMDLGEMCDDTVTYKCPLIAEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEATLPEEQDQNYVCKHTYVDRGWGNGCGLFGKGSLVTCAKFQCLEPIEGKVVQYENLKYTVIITVHTGDQHQVGNDTQGVTVEITPQASTVEAVLPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCLNTFVLKKEVSETQHGTILIKVEYKGEDAPCKIPFSTEDGQGKAHNGRLITANPVVTKKEEPVNIEAEPPFGESNIVIGIGDKALKINWYKKGSSIGKMFEATARGARRMAILGDTAWDFGSVGGVLNSLGKMVHQVFGSAYTALFSGVSWIMKIGIGVLLTWIGLNSKNTSMSFSCIVIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSASRAWNVWEVEDYGFGVFTTNIWLKLREVYTQSCDHRLMSAAIKDERAVHADMGYWIESQKNGSWKLEKASFIEVKTCTWPKSHTLWSNGVLESDMIIPKSLAGPISQHNHRPGYHTQTAGPWHLGKLELDFNYCEGTTVAITENCGTRGPSLRTTTVSGKLIHEWCCRSCTLPPLRYMGEDGCWYGMEIRPINEKEENMVKSLVSAGSGKVDNFTMGVLCLAILFEEVMRGKFGKKHMIAGVLFTFVLLLSGQITWRDMAHTLIMIGSNASDRMGMGVTYLALIATFKIQPFLALGFFLRKLTSRENLLLGVGLAMATTLQLPEDIEQMANGIALGLMTLKLITQFETYQLWTALVSLTCSNTIFTLTVAWRTATLILAGVSLLPLCQSSSMRKTDWLPMTVAAMGVPPLPLFIFSLKDTPKRRSWPLNEGVMAVGLVSILASSLLRNDVPMAGPLVAGGLLIACYVITGTSADLTVEKAADVTWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTHNGKRLEPNWASVKKDLISYGGGWRLSAQWQKGEEVQVIAVEPGKNPKNFQTMPGIFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLVIMDEAHFTDPASIAARGYISTRVGMGEAAAIFMTATPPGTAEAFPQSNAPIQDEERDIPERSWNSGNEWITDFVGKTVWFVPSIKAGNDIANCLRKNGKKVIQLSRKTFDTEYQKTRLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGERNNQILEENMDVEIWTKEGERKKLRPRWLDARTYSDPLALKEFKDFAAGRKSIALDLVTEIGRVPSHLAHRTRNALDNLVMLHTSEHGGRAYRHAVEELPETMETLLLLGLMILLTGGAMLFLISGKGIGKTSIGLICVIVSSGMLWMADVPLQWIASAIVLEFFMMVLLIPEPEKQRTPQDNQLAYVVIGILTLAAIVAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLVTHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGRRGTGSQGETLGEKWKKKLNQLSRKEFDLYKKSGITEVDRTEAKEGLKRGETTHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKYGGMLVRNPLSRNSTHEMYWISNGTGNIVSSVNMVSRLLLNRFTMTHRRPTIEKDVDLGAGTRHVNAEPETPNMDVIGERIKRIKEEHSSTWHYDDENPYKTWAYHGSYEVKATGSASSMINGVVKLLTKPWDVVPMVTQMAMTDTTPFGQQRVFKEKVDTRTPRPMPGTRKVMEITAEWLWRTLGRNKKPRLCTREEFTKKVRTNAAMGAVFTEENQWDSARAAVEDEEFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPKGTVMDIISRKDQRGSGQVGTYGLNTFTNMEAQLVRQMEGEGVLSKADLENPHQLEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLKETACLGKAYAQMWSLMYFHRRDLRLASNAICSAVPVHWIPTSRTTWSIHAHHQWMTTEDMLTVWNRVWIEDNPWMEDKTPVTTWEDVPYLGKREDQWCGSLIGLTSRATWAQNILTAIQQVRSLIGDEEFLDYMPSMKRFRKEEESEGAIW

SEQ ID NO: 4690 - protein, 3290 aa, Artificial Sequence
  derived and/or modified protein sequence (wt) from DENV-3__FJ639719__SS-prME
TSLCLMMMLPATLAFHLTSRDGEPRMIVGKNERGKSLLFKTATGINMCTLIAMDLGEMCDDTVTYKCPLIAEVEPEDIDCWCNLTSTWVTYGTCNQAGEHRRDKRSVALAPHVGMGLDTRTQTWMSAEGAWRQVEKVETWALRHPGFTILALFLAHYIGTSLIQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAILPEEQDQNYVCKHTYVDRGWGNGCGLFGKGSLVTCAKFQCLEPIEGKVVQYENLKYTVIITVHTGDQHQVGNDTQGVTVEITPQASTVEAVLPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCLNTFVLKKEVSETQHGTILIKVEYKGEDAPCKIPFSTEDGQGKAHNGRLITANPVVTKKEEPVNIEAEPPFGESNIVIGIGDKALKINWYKKGSSIGKMFEATARGARRMAILGDTAWDFGSVGGVLNSLGKMVHQIFGSAYTALFSGVSWIMKIGIGVLLTWIGLNSKNTSMSFSCIVIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSASRAWNVWEVEDYGFGVFTTNIWLKLREVYTQSCDHRLMSAAIKDERAVHADMGYWIESQKNGSWKLEKASFIEVKTCTWPKSHTLWSNGVLESDMIIPKSLAGPISQHNHRPGYHTQTAGPWHLGKLELDFNYCEGTTVVITENCGTRGPSLRTTTVSGKLIHEWCCRSCTLPPLRYMGEDGCWYGMEIRPINEKEENMVKSLVSAGSGKVDNFTMGVLCLAILFEEVMRGKFGKKHMIAGVLFTFVLLLSGQITWRDMAHTLIMIGSNASDRMGMGVTHLALIATFKIQPFLALGFFLRKLTSRENLLLGVGLAMATTLQLPEDIEQMANGIALGLMTLKLITQFETYQLWTALVSLTCSNTIFTLTVAWRTATLILAGVSLLPLCQSSSMRKTDWLPMTVAAMGVPPLPLFIFSLKDTPKRRSWPLNEGVMAVGLVSILASSLLRNDVPMAGPLVAGGLLIACYVITGTSADLTVEKAADVTWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTHNGKRLEPNWASVKKDLISYGGGWRLSTQWQKGEEVQVIAVEPGKNPKNFQTMPGIFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTAEAFPQSNAPIQDEERDIPERSWNSGNEWITDFVGKTVWFVPSIKAGNDIANCLRKNGKKVIQLSRKTFDTEYQKTRLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGERNNQILEENMDVEIWTKEGERKKLRPRWLDARTYSDPLALKEFKDFAAGRKSIALDLVTEIGRVPSHLAHRTRNALDNLVMLHTSEHGGRAYRHAVEELPETMETLLLLGLMILLTGGAMLFLVSGKGIGKTTIGLICVIVSSGMLWMADIPLQWIASAIVLEFFMMVLLIPEPEKQRTPQDNQLAYVVIGILTLAAIVAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLVTHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGRRGTGSQGETLGEKWKKKLNQLSRKEFDLYKKSGITEVDRTEAKEGLKRGETTHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKYGGMLVRNPLSRNSTHEMYWISNGTGNIVSSVNMVSRLLLNRFTMTHRRPTIEKDVDLGAGTRHVNAEPETPNMDVIGERIKRIKEEHSSTWHYDDENPYKTWAYHGSYEVKATGSASSMINGVVKLLTKPWDVVPMVTQMAMTDTTPFGQQRVFKEKVDTRTPRPMPGTRKVMEITAEWLWRTLGRNKKPRLCTREEFTKKVRTNAAMGAVFTEENQWDSARAAVEDEEFWKLVDRERELHKLGKCGSCVYNMMGKREKKLGEFGKAKGSRAIWYMWLGARFLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPKGTVMDIISRKDQRGSGQVGTYGLNTFTNMEAQLVRQMEGEGVLSKADLENPHLLEKKITQWLENKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLKETACLGKAYAQMWSLMYFHRRDLRLASNAICSAVPVHWVPTSRTTWSIHAHHQWMTTEDMLTVWNRVWIEDNPWMEDKTPVTTWEDVPYLGKREDQWCGSLIGLTSRATWAQNILTAIQQVRSLIGDEEFLDYMPSMKRFRKEEESEGAIW

SEQ ID NO: 4691 - protein, 3290 aa, Artificial Sequence
  derived and/or modified protein sequence (wt) from DENV-3__KF955332__SS-prME
TSLCLMMMLPATLAFHLTSRDGEPRMIVGKNERGKSLLFKTATGINMCTLIAMDLGEMCDDTVTYKCPLIAEVEPEDIDCWCNLTSTWVTYGTCNQAGEHRRDKRSVALAPHVGMGLDTRTQTWMSAEGAWRQVEKVETWALRHPGFTILALFLAHYIGTSLIQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAILPEEQDQNYVCKHTYVDRGWGNGCGLFGKGSLVTCAKFQCLEPIEGKVVQYENLKYTVIITVHTGDQHQVGNDTQGVTVEITPQASTVEAVLPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCLNTFVLKKEVSETQHGTILIKVEYKGEDAPCKIPFSTEDGQGKAHNGRLITANPVVTKKEEPVNIEAEPPFGESNIVIGIGDKALKINWYKKGSSIGKMFEATARGARRMAILGDTAWDFGSVGGVLNSLGKMVHQIFGSAYTALFSGVSWIMKIGIGVLLTWIGLNSKNTSMSFSCIVIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSASRAWNVWEVEDYGFGVFTTNIWLKLREVYTQSCDHRLMSAAIKDERAVHADMGYWIESQKNGSWKLEKASFIEVKTCTWPKSHTLWSNGVLESDMIIPKSLAGPISQHNHRPGYHTQTAGPWHLGKLELDFNYCEGTTVVITENCGTRGPSLRTTTVSGKLIHEWCCRSCTLPPLRYMGEDGCWYGMEIRPINEKEENMVKSLVSAGSGKVDNFTMGVLCLAILFEEVMRGKFGKKHMIAGVLFTFVLLLSGQITWRDMAHTLIMIGSNASDRMGMGVTYLALIATFKIQPFLALGFFLRKLTSRENLLLGVGLAMATTLQLPEDIEQMANGIALGLMTLKLITQFETYQLWTALVSLTCSNTIFTLTVAWRTATLILAGVSLLPLCQSSSMRKTDWLPMTVAAMGVPPLPLFIFSLKDAPKRRSWPLNEGVMAVGLVSILASSLLRNDVPMAGPLVAGGLLIACYVITGTSADLTVEKAADVTWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTHNGKRLEPNWASVKKDLISYGGGWRLSTQWQKGEEVQVIAVEPGKNPKNFQTMPGIFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTAEAFPQSNAPIQDEERDIPERSWNSGNEWITDFVGKTVWFVPSIKAGNDIANCLRKNGKKVIQLSRKTFDTEYQKTRLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGERNNQILEENMDVEIWTKEGERKKLRPRWLDARTYSDPLALKEFKDFAAGRKSIALDLVTEIGRVPSHLAHRTRNALDNLVMLHTSEHGGRAYRHAVEELPETMETLLLLGLMILLTGGAMLFLVSGKGIGKTTIGLICVIVSSGMLWMADIPLQWIASAIVLEFFMMVLLIPEPEKQRTPQDNQLAYVVIGILTLAAIVAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLVTHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGRRGTGSQGETLGEKWKKKLNQLSRKEFDLYKKSGITEVDRTEAKEGLKRGETTHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKYGGMLVRNPLSRNSTHEMYWISNGTGNIVSSVNMVSRLLLNRFTMTHRRPTIEKDVDLGAGTRHVNAEPETPNMDVIGERIKRIKEEHSSTWHYDDENPYKTWAYHGSYEVKATGSASSMINGVVKLLTKPWDVVPMVTQMAMTDTTPFGQQRVFKEKVDTRTPRPMPGTRKVMEITAEWLWRTLGRNKKPRLCTREEFTKKVRTNAAMGAVFTEENQWDSARAAVEDEEFWKLVDRERELHKLGKCGSCVYNMMGKREKKLGEFGKAKGSRAIWYMWLGARFLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPKGTVMDIISRKDQRGSGQVGTYGLNTFTNMEAQLVRQMEGEGVLSKTDLENPHLLEKKITQWLENKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLKETACLGKAYAQMWSLMYFHRRDLRLASNAICSAVPVHWVPTSRTTWSIHAHHQWMTTEDMLTVWNRVWIEDNPWMEDKTPVTTWEDVPYLGKREDQWCGSLIGLTSRATWAQNILTAIQQVRSLIGDEEFLDYMPSMKRFRKEEESEGAIW

SEQ ID NO: 4692 - protein, 3290 aa, Artificial Sequence
  derived and/or modified protein sequence (wt) from DENV-3__FJ639720__SS-prME
TSLCLMMMLPATLAFHLTSRDGEPRMIVGKNERGKSLLFKTATGINMCTLIAMDLGEMCDDTVTYKCPLIAEVEPEDIDCWCNLTSTWVTYGTCNQAGEHRRDKRSVALAPHVGMGLDTRTQTWMSAEGAWRQVEKVETWALRHPGFTILALFLAHYIGTSLIQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAILPEEQDQNYVCKHTYVDRGWGNGCGLFGKGSLVTCAKFQCLEPIEGKVVQYENLKYTVIITVHTGDQHQVGNDTQGVTVEITPQASTVEAVLPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCLNTFVLKKEVSETQHGTILIKVEYKGEDAPCKIPFSTEDGQGKAHNGRLITANPVVTKKEEPVNIEAEPPFGESNIVIGIGDKALRINWYKKGSSIGKMFEATARGARRMAILGDTAWDFGSVGGVLNSLGKMVHQIFGSAYTALFSGVSWIMKIGIGVLLTWIGLNSKNTSMSFSCIVIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSASRAWNVWEVEDYGFGVFTTNIWLKLREVYTQSCDHRLMSAAIKDERAVHADMGYWIESQKNGSWKLEKASFIEVKTCTWPKSHTLWSNGVLESDMIIPKSLAGPISQHNHRPGYHTQTAGPWHLGKLELDFNYCEGTTVVITENCGTRGPSLRTTTVSGKLIHEWCCRSCTLPPLRYMGEDGCWYGMEIRPINEKEENMVKSLVSAGSGKVDNFTMGVLCLAILFEEVMRGKFGKKHMIAGVLFTFVLLLSGQITWRDMAHTLIMIGSNASDRMGMGVTYLALIATFKIQPFLALGFFLRKLTSRENLLLGVGLAMATTLQLPEDIEQMANGIALGLMTLKLITQFETYQLWTALVSLTCSNTIFTLTVAWRTATLILAGVSLLPLCQSSSMRKTDWLPMTVAAMGVPPLPLFIFSLKDTPKRRSWPLNEGVMAVGLVSILASSLLRNDVPMAGPLVAGGLLIACYVITGTSADLTVEKAADVTWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTHNGKRLEPNWASVKKDLISYGGGWRLSTQWQKGEEVQVIAVEPGKNPKNFQTMPGIFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTAEAFPQSNAPIQDEERDIPERSWNSGNEWITDFVGKTVWFVPSIKAGNDIANCLRKNGKKVIQLSRKTFDTEYQKTRLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGERNNQILEENMDVEIWTKEGERKKLRPRWLDARTYSDPLALKEFKDFAAGRKSIAIDLVTEIGRVPSHLAHRTRNALDNLVMLHTSEHGGRAYRHAVEELPETMETLLLLGLMILLTGGAMLFLVSGKGIGKTTIGLICVIVSSGMLWMADIPLQWIASAIVLEFFMMVLLIPEPEKQRTPQDNQLAYVVIGILTLAAIVAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLVTHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGRRGTGSQGETLGEKWKKKLNQLSRKEFDLYKKSGITEVDRTEAKEGLKRGETTHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKYGGMLVRNPLSRNSTHEMYWISNGTGNIVSSVNMVSRLLLNRFTMTHRRPTIEKDVDLGAGTRHVNAEPETPNMDVIGERIKRIKEEHSSTWHYDDENPYKTWAYHGSYEVKATGSASSMINGVVKLLTKPWDVVPMVTQMAMTDTTPFGQQRVFKEKVDTRTPRPMPGTRKVMEITAEWLWRTLGRNKKPRLCTREEFTKKVRTNAAMGAVFTEENQWDSARAAVEDEEFWKLVDRERELHKLGKCGSCVYNMMGKREKKLGEFGKAKGSRAIWYMWLGARFLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPKGTVMDIISRKDQRGSGQVGTYGLNTFTNMEAQLVRQMEGEGVLSKTDLENPHLLEKKITQWLENKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLKETACLGKAYAQMWSLMYFHRRDLRLASNAICSAVPVHWVPTSRTTWSIHAHHQWMTTEDMLTVWNRVWIEDNPWMEDKTPVTTWEDVPYLGKREDQWCGSLIGLTSRATWAQNILTAIQQVRSLIGDEEFLDYMPSMKRFRKEEESEGAIW

SEQ ID NO: 4693 - protein, 3290 aa, Artificial Sequence
  derived and/or modified protein sequence (wt) from DENV-3__GQ868626__SS-prME
TSLCLMMMLPATLAFHLTSRDGEPRMIVGKNERGKSLLFKTATGINMCTLIAMDLGEMCDDTVTYKCPLIAEVEPEDIDCWCNLTSTWVTYGTCNQAGEHRRDKRSVALAPHVGMGLDTRTQTWMSAEGAWRQVEKVETWALRHPGFTILALFLAHYIGTSLIQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAILPEEQDQNYVCKHTYVDRGWGNGCGLFGKGSLVTCAKFQCLEPIEGKVVQYENLKYTVIITVHTGDQHQVGNDTQGVTVEITPQASTVEAVLPEYGTLGLECSPRTGLDFNEMILLTMKNKAWMVHRQWFFDLPLPWTSGATIETPTWNRKELLVTFKNAHAKKQEVVVLGSQEGAMHTALTGATEIQNSGGTSIFAGHLKCRLKMDKLELKGMSYAMCLNTFVLRKEVSETQHGTILIKVEYKGEDAPCKIPFSTEDGQGKAHNGRLITANPVVTKKEEPVNIEAEPPFGESNIVIGIGDKALKINWYKKGSSIGKMFEATARGARRMAILGDTAWDFGSVGGVLNSLGKMVHQIFGSAYTALFSGVSWIMKIGIGVLLTWIGLNSKNTSMSFSCIVIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSASRAWNVWEVEDYGFGVFTTNIWLKLREVYTQSCDHRLMSAAIKDERAVHADMGYWIESQKNGSWKLEKASFIEVKTCTWPKSHTLWSNGVLESDMIIPKSLAGPISQHNHRPGYHTQTAGPWHLGKLELDFNYCEGTTVVITENCGTRGPSLRTTTVSGKLIHEWCCRSCTLPPLRYMGEDGCWYGMEIRPINEKEENMVKSLVSAGSGKVDNFTMGVLCLAILFEEVMRGKFGKKHMIAGVLFTFVLLLSGQITWRDMAHTLIMIGSNASDRMGMGVTYLALIATFKIQPFLALGFFLRKLTSRENLLLGVGLAMATTLQLPEDIEQMANGIALGLMTLKLITQFETYQLWTALVSLTCSNTIFTLTVAWRTATLILAGVSLLPLCQSSSMRKTDWLPMTVAAMGVPPLPLFIFSLKDTPKRRSWPLNEGVMAVGLVSILASSLLRNDVPMAGPLVAGGLLIACYVITGTSADLTVEKAADVTWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTHNGKRLEPNWASVKKDLISYGGGWRLSTQWQKGEEVQVIAVEPGKNPKNFQTMPGIFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTAEAFPQSNAPIQDEERDIPERSWNSGNEWITDFVGKTVWFVPSIKAGNDIANCLRKNGKKVIQLSRKTFDTEYQKTRLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAYKVASEGIKYTDRKWCFDGERNNQILEENMDVEIWTKEGERKKLRPRWLDARTYSDPLALKEFKDFAAGRKSIALDLVTEIGRVPSHLAHRTRNALDNLVMLHTSEHGGRAYRHAVEELPETMETLLLLGLMILLTGGAMLFLISGKGIGKTTIGLICVIVSSGMLWMADIPLQWIASAIVLEFFMMVLLIPEPEKQRTPQDNQLAYVVIGILTLAAIVAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLVTHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGRRGTGSQGETLGEKWKKKLNQLSRKEFDLYKKSGITEVDRTEAKEGLKRGETTHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKYGGMLVRNPLSRNSTHEMYWISNGTGNIVSSVNMVSRLLLNRFTMTHRRPTIEKDVDLGAGTRHVNAEPETPNMDVIGERIKRIKEEHSSTWHYDDENPYKTWAYHGSYEVKATGSASSMINGVVKLLTKPWDVVPMVTQMAMTDTTPFGQQRVFKEKVDTRTPRPMPGTRKVMEITAEWLWRTLGRNKKPRLCTREEFTKKVRTNAAMGAVFTEENQWDSARAAVEDEEFWKLVDRERELHKLGKCGSCVYNMMGKREKKLGEFGKAKGSRAIWYMWLGARFLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPKGTVMDIISRKDQRGSGQVGTYGLNTFTNMEAQLVRQMEGEGVLSKADLENPHLLEKKITQWLENKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLKETACLGKAYAQMWSLMYFHRRDLRLASNAICSAVPVHWVPTSRTTWSIHAHHQWMTTEDMLAVWNRVWIEDNPWMEDKTPVTTWEDVPYLGKREDQWCGSLIGLTSRATWAQNILTAIQQVRSLIGDEEFLDYMPSMKRFRKEEESEGAIW

SEQ ID NO: 4694 - protein, 3290 aa, Artificial Sequence
  derived and/or modified protein sequence (wt) from DENV-3__GQ868627__SS-prME
TSLCLMMMLPATLAFHLTSRDGEPRMIVGKNERGKSLLFKTATGINMCTLIAMDLGEMCDDTVTYKCPLIAEVEPEDIDCWCNLTSTWVTYGTCNQAGEHRRDKRSVALAPHVGMGLDTRTQTWMSAEGAWRQVEKVETWALRHPGFTILALFLAHYIGTSLIQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAILPEEQDQNYVCKHTYVDRGWGNGCGLFGKGSLVTCAKFQCLEPIEGKVVQYENLKYTVIITVHTGDQHQVGNDTQGVTVEITPQASTVEAVLPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCLNTFVLRKEVSETQHGTILIKVEYKGEDAPCKIPFSTEDGQGKAHNGRLITANPVVTKKEEPVNIEAEPPFGESNIVIGIGDKALKINWYKKGSSIGKMFEATARGARRMAILGDTAWDFGSVGGVLNSLGKMVHQIFGSAYTALFSGVSWIMKIGIGVLLTWIGLNSKNTSMSFSCIVIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSASRAWNVWEVEDYGFGVFTTNIWLKLREVYTQSCDHRLMSAAIKDERAVHADMGYWIESQKNGSWKLEKASFIEVKTCTWPKSHTLWSNGVLESDMIIPKSLAGPISQHNHRPGYHTQTAGPWHLGKLELDFNYCEGTTVVITENCGTRGPSLRTTTVSGKLIHEWCCRSCTLPPLRYMGEDGCWYGMEIRPINEKEENMVKSLVSAGSGKVDNFTMGVLCLAILFEEVMRGKFGKKHMIAGVLFTFVLLLSGQITWRDMAHTLIMIGSNASDRMGMGVTYLALIATFKIQPFLALGFFLRKLTSRENLLLGVGLAMATTLQLPEDIEQMANGIALGLMTLKLITQFETYQLWTALVSLTCSNTIFTLTVAWRTATLILAGVSLLPLCQSSSMRKTDWLPMTVAAMGVPPLPLFIFSLKDTPKRRSWPLNEGVMAVGLVSILASSLLRNDVPMAGPLVAGGLLIACYVITGTSADLTVEKAADVTWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTHNGKRLEPNWASVKKDLISYGGGWRLSTQWQKGEEVQVIAVEPGKNPKNFQTMPGIFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTAEAFPQSNAPIQDEERDIPERSWNSGNEWITDFVGKTVWFVPSIKAGNDIANCLRKNGKKVIQLSRKTFDTEYQKTRLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAYKVASEGIKYTDRKWCFDGERNNQILEENMDVEIWTKEGERKKLRPRWLDARTYSDPLALKEFKDFAAGRKSIALDLVTEIGRVPSHLAHRTRNALDNLVMLHTSEHGGRAYRHAVEELPETMETLLLLGLMILLTGGAMLFLISGKGIGKTTIGLICVIVSSGMLWMADIPLQWIASAIVLEFFMMVLLIPEPEKQRTPQDNQLAYVVIGILTLAAIVAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLVTHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGRRGTGSQGETLGEKWKKKLNQLSRKEFDLYKKSGITEVDRTEAKEGLKRGETTHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKYGGMLVRNPLSRNSTHEMYWISNGTGNIVSSVNMVSRLLLNRFTMTHRRPTIEKDVDLGAGTRHVNAEPETPNMDVIGERIKRIKEEHSSTWHYDDENPYKTWAYHGSYEVKATGSASSMINGVVKLLTKPWDVVPMVTQMAMTDTTPFGQQRVFKEKVDTRTPRPMPGTRKVMEITAEWLWRTLGRNKKPRLCTREEFTKKVRTNAAMGAVFTEENQWDSARAAVEDEEFWKLVDRERELHKLGKCGSCVYNMMGKREKKLGEFGKAKGSRAIWYMWLGARFLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPKGTVMDIISRKDQRGSGQVGTYGLNTFTNMEAQLVRQMEGEGVLSKADLENPHLLEKKITQWLENKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLKETACLGKAYAQMWSLMYFHRRDLRLASNAICSAVPVHWVPTSRTTWSIHAHHQWMTTEDMLAVWNRVWIEDNPWMEDKTPVTTWEDVPYLGKREDQWCGSLIGLTSRATWAQNILTAIQQVRSLIGDEEFLDYMPSMKRFRKEEESEGAIW

SEQ ID NO: 4695 - protein, 3290 aa, Artificial Sequence
  derived and/or modified protein sequence (wt) from DENV-3__FJ639721__SS-prME
TSLCLMMMLPATLAFHLTSRDGEPRMIVGKNERGKSLLFKTATGINMCTLIAMDLGEMCDDTVTYKCPLIVEVEPEDIDCWCNLTSTWVTYGTCNQAGEHRRDKRSVALAPHVGMGLDTRTQTWMSAEGAWRQVEKVETWALRHPGFTILALFLAHYIGTSLIQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAILPEEQDQNYVCKHTYVDRGWGNGCGLFGKGSLVTCAKFQCLEPIEGKVVQYENLKYTVIITVHTGDQHQVGNDTQGVTVEITPQASTVEAVLPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCLNTFVLKKEVSETQHGTILIKVEYKGEDAPCKIPFSTEDGQGKAHNGRLITANPVVTKKEEPVNIEAEPPFGESNIVIGIGDKALKINWYKKGSSIGKMFEATARGARRMAILGDTAWDFGSVGGVLNSLGKMVHQIFGSAYTALFSGVSWIMKIGIGVLLTWIGLNSKNTSMSFSCIVIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSASRAWNVWEVEDYGFGVFTTNIWLKLREVYTQSCDHRLMSAAIKDERAVHADMGYWIESQKNGSWKLEKASFIEVKTCTWPKSHTLWSNGVLESDMIIPKSLAGPISQHNHRPGYHTQTAGPWHLGKLELDFNYCEGTTVVITENCGTRGPSLRTTTVSGKLIHEWCCRSCTLPPLRYMGEDGCWYGMEIRPINEKEENMVKSLVSAGSGKVDNFTMGVLCLAILFEEVMRGKFGKKHMIAGVLFTFVLLLSGQITWRDMAHTLIMIGSNASDRMGMGVTYLALIATFKIQPFLTLGFFLRKLTSRENLLLGVGLAMATTLQLPEDIEQMANGIALGLMTLKLITQFETYQLWTALVSLTCSNTIFTLTVAWRTATLILAGVSLLPLCQSSSMRKTDWLPMTVAAMGVPPLPLFIFSLKDAPKRRSWPLNEGVMAVGLVSILASSLLRNDVPMAGPLVAGGLLIACYVITGTSADLTVEKAADVTWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTHNGKRLEPNWASVKKDLISYGGGWRLSTQWQKGEEVQVIAVEPGKNPKNFQTMPGIFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTAEAFPQSNAPIQDEERDIPERSWNSGNEWITDFVGKTVWFVPSIKAGNDIANCLRKNGKKVIQLSRKTFDTEYQKTRLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGERNNQILEENMDVEIWTKEGERKKLRPRWLDARTYSDPLALKEFKDFAAGRKSIALDLVTEIGRVPSHLAHRTRNALDNLVMLHTSEHGGRAYRHAVEELPETMETLLLLGLMILLTGGAMLFLVSGKGIGKTTIGLICVIVSSGMLWMADIPLQWIASAIVLEFFMMVLLIPEPEKQRTPQDNQLAYVVIGILTLAAIVAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLVTHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGRRGTGSQGETLGEKWKKKLNQLSRKEFDLYKKSGITEVDRTEAKEGLKRGETTHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKYGGMLVRNPLSRNSTHEMYWISNGTGNIVSSVNMVSRLLLNRFTMTHRRPTIEKDVDLGAGTRHVNAEPETPNMDVIGERIKRIKEEHSSTWHYDDENPYKTWAYHGSYEVKATGSASSMINGVVKLLTKPWDVVPMVTQMAMTDTTPFGQQRVFKEKVDTRTPRPMPGTRKVMEITAEWLWRTLGRNKKPRLCTREEFTKKVRTNAAMGAVFTEENQWDSARAAVEDEEFWKLVDRERELHKLGKCGSCVYNMMGKREKKLGEFGKAKGSRAIWYMWLGARFLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPKGTVMDIISRKDQRGSGQVGTYGLNTFTNMEAQLVRQMEGEGVLSKTDLENPHLLEKKITQWLENKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLKETACLGKAYAQMWSLMYFHRRDLRLASNAICSAVPVHWVPTSRTTWSIHAHHQWMTTEDMLTVWNRVWIEDNPWMEDKTPVTTWEDVPYLGKREDQWCGSLIGLTSRATWAQNILTAIQQVRSLIGDEEFLDYMPSMKRFRKEEESEGAIW

SEQ ID NO: 4696 - protein, 3290 aa, Artificial Sequence
  derived and/or modified protein sequence (wt) from DENV-3__FJ639722__SS-prME
TSLCLMMMLPATLAFHLTSRDGEPRMIVGKNERGKSLLFKTATGINMCTLIAMDLGEMCDDTVTYKCPLIAEVEPEDIDCWCNLTSTWVTYGTCNQAGEHRRDKRSVALAPHVGMGLDTRTQTWMSAEGAWRQVEKVETWALRHPGFTILALFLAHYIGTSLIQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAILPEEQDQNYVCKHTYVDRGWGNGCGLFGKGSLVTCAKFQCLEPIEGKVVQYENLKYTVIITVHTGDQHQVGNDTQGVTVEITPQASTVEAVLPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCLNTFVLKKEVSETQHGTILIKVEYKGEDAPCKIPFSTEDGQGKAHNGRLITANPVVTKKEEPVNIEAEPPFGESNIVIGIGEKALKINWYKKGSSIGKMFEATARGARRMAILGDTAWDFGSVGGVLNSLGKMVHQIFGSAYTALFSGVSWIMKIGIGVLLTWIGLNSKNTSMSFSCIVIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSASRAWNVWEVEDYGFGVFTTNIWLKLREVYTQSCDHRLMSAAIKDERAVHADMGYWIESQKNGSWKLEKASFIEVKTCTWPKSHTLWSNGVLESDMIIPKSLAGPISQHNHRPGYHTQTAGPWHLGKLELDFNYCEGTTVVITENCGTRGPSLRTTTVSGKLIHEWCCRSCTLPPLRYMGEDGCWYGMEIRPINEKEENMVKSLVSAGSGKVDNFTMGVLCLAILFEEVMRGKFGKKHMIAGVLFTFVLLLSGQITWRDMAHTLIMIGSNASDRMGMGVTYLALIATFKIQPFLALGFFLRKLTSRENLLLGVGLAMATTLQLPEDIEQMANGIALGLMTLKLITQFETYQLWTALVSLTCSNTIFTLTVAWRTATLILAGVSLLPLCQSSSMRKTDWLPMTVAAMGVPPLPLFIFSLKDAPKRRSWPLNEGVMAVGLVSILASSLLRNDVPMAGPLVAGGLLIACYVITGTSADLTVEKAADVTWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTHNGKRLEPNWASVKKDLISYGGGWRLSTQWQKGEEVQVIAVEPGKNPKNFQTMPGIFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTAEAFPQSNAPIQDEERDIPERSWNSGNEWITDFVGKTVWFVPSIKAGNDIANCLRKNGKKVIQLSRKTFDTEYQKTRLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGERNNQILEENMDVEIWTKEGERKKLRPRWLDARTYSDPLALKEFKDFAAGRKSIALDLVTEIGRVPSHLAHRTRNALDNLVMLHTSEHGGRAYRHAVEELPETMETLLLLGLMILLTGGAMLFLVSGKGIGKTTIGLICVIVSSGMLWMADIPLQWIASAIVLEFFMMVLLIPEPEKQRTPQDNQLAYVVIGILTLAAIVAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLVTHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGRRGTGSQGETLGEKWKKKLNQLSRKEFDLYKKSGITEVDRTEAKEGLKRGETTHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKYGGMLVRNPLSRNSTHEMYWISNGTGNIVSSVNMVSRLLLNRFTMTHRRPTIEKDVDLGAGTRHVNAEPETPNMDVIGERIKRIKEEHSSTWHYDDENPYKTWAYHGSYEVKATGSASSMINGVVKLLTKPWDVVPMVTQMAMTDTTPFGQQRVFKEKVDTRTPRPMPGTRKVMEITAEWLWRTLGRNKKPRLCTREEFTKKVRTNAAMGAVFTEENQWDSARAAVEDEEFWKLVDRERELHKLGKCGSCVYNMMGKREKKLGEFGKAKGSRAIWYMWLGARFLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPKGTVMDIISRKDQRGSGQVGTYGLNTFTNMEAQLVRQMEGEGVLSKTDLENPHLLEKKITQWLENKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLKETACLGKAYAQMWSLMYFHRRDLRLASNAICSAVPVHWVPTSRTTWSIHAHHQWMTTEDMLTVWNRVWIEDNPWMEDKTPVTTWEDVPYLGKREDQWCGSLIGLTSRATWAQNILTAIQQVRSLIGDEEFLDYMPSMKRFRKEEESEGAIW

SEQ ID NO: 4697 - protein, 3290 aa, Artificial Sequence
  derived and/or modified protein sequence (wt) from DENV-3__FJ639723__SS-prME
TSLCLMMMLPATLAFHLTSRDGEPRMIVGKNERGKSLLFKTATGINMCTLIAMDLGEMCDDTVTYKCPLIAEVEPEDIDCWCNLTSAWVTYGTCNQAGEHRRDKRSVALAPHVGMGLDTRTQTWMSAEGAWRQVEKVETWALRHPGFTILALFLAHYIGTSLIQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAILPEEQDQNYVCKHTYVDRGWGNGCGLFGKGSLVTCAKFQCLEPIEGKVVQYENLKYTVIITVHTGDQHQVGNDTQGVTVEITPQASTVEAVLPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCLNTFVLRKEVSETQHGTILIKVEYKGEDAPCKIPFSTEDGQGKAHNGRLITANPVVTKKEEPVNIEAEPPFGESNIVIGIGDKALKINWYKKGSSIGKMFEATARGARRMAILGDTAWDFGSVGGVLNSLGKMVHQIFGSAYTALFSGVSWIMKIGIGVLLTWIGLNSKNTSMSFSCIVIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSASRAWNVWEVEDYGFGVFTTNIWLKLREVYTQSCDHRLMSAAIKDERAVHADMGYWIESQKNGSWKLEKASFIEVKTCTWPKSHTLWSNGVLESDMIIPKSLAGPISQHNHRPGYHTQTAGPWHLGKLELDFNYCEGTTVVITENCGTRGPSLRTTTVSGKLIHEWCCRSCTLPPLRYMGEDGCWYGMEIRPTNEKEENMVKSLVSAGSGKVDNFTMGVLCLAILFEEVMRGKFGKKHMIAGVLFTFVLLLSGQITWRDMAHTLIMIGSNASDRMGMGVTYLALIATFKIQPFLALGFFLRKLTSRENLLLGVGLAMATTLQLPEDIEQMANGIALGLMTLKLITQFETYQLWTALVSLTCSNTIFTLTVAWRTATLILAGVSLLPLCQSSSMRKTDWLPMTVAAMGVPPLPLFIFSLKDTPKRRSWPLNEGVMAVGLVSILASSLLRNDVPMAGPLVAGGLLIACYVITGTSADLTVEKAADVTWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTHNGKRLEPNWASVKKDLISYGGGWRLSTQWQKGEEVQVIAVEPGKNPKNFQTMPGIFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTAEAFPQSNAPIQDEERDIPERSWNSGNEWITDFVGKTVWFVPSIKAGNDIANCLRKNGKKVIQLSRKTFDTEYQKTRLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAYKVASEGIKYTDRKWCFDGERNNQILEENMDVEIWTKEGERKKLRPRWLDARTYSDPLALKEFKDFAAGRKSIALDLVTEIGRVPSHLAHRTRNALDNLVMLHTSEHGGRAYRHAVEELPETMETLLLLGLMILLTGGAMLFLISGKGIGKTTIGLICVIVSSGMLWMADIPLQWIASAIVLEFFMMVLLIPEPEKQRTPQDNQLAYVVIGILTLAAIVAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLVTHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGRRGTGSQGETLGEKWKKKLNQLSRKEFDLYKKSGITEVDRTEAKEGLKRGETTHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKYGGMLVRNPLSRNSTHEMYWISNGTGNIVSSVNMVSRLLLNRFTMTHRRPTIEKDVDLGAGTRHVNAEPETPNMDVIGERIKRIKEEHSSTWHYDDENPYKTWAYHGSYEVKATGSASSMINGVVKLLTKPWDVVPMVTQMAMTDTTPFGQQRVFKEKVDTRTPRPMPGTRKVMEITAEWLWRTLGRNKKPRLCTREEFTKKVRTNAAMGAVFTEENQWDSARAAVEDEEFWKLVDRERELHKLGKCGSCVYNMMGKREKKLGEFGKAKGSRAIWYMWLGARFLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPKGTVMDIISRKDQRGSGQVGTYGLNTFTNMEAQLVRQMEGEGVLSKADLENPHLLEKKITQWLENKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLKETACLGKAYAQMWSLMYFHRRDLRLASNAICSAVPVHWVPTSRTTWSIHAHHQWMTTEDMLAVWNRVWIEDNPWMEDKTPVTTWEDVPYLGKREDQWCGSLIGLTSRATWAQNILTAIQQVRSLIGDEEFLDYMPSMKRFRKEEESEGAIW

SEQ ID NO: 4698 - protein, 3290 aa, Artificial Sequence
  derived and/or modified protein sequence (wt) from DENV-3__FJ639724__SS-prME
TSLCLMMMLPATLAFHLTSRDGEPRMIVGKNERGKSLLFKTASGINMCTLIAMDLGEMCDDTVTYKCPLIAEVEPEDIDCWCNLTSTWVTYGTCNQAGEHRRDKRSVALAPHVGMGLDTRTQTWMSAEGAWRQVERVETWALRHPGFTILALFLAHYIGTSLTQKVVIFILLMLVTPSMTMRCVGVGNRDFVEGLSGATWVDVVLEHGGCVTTMAKSKPTLDIELQKTEATQLATLRKLCIEGKITNITTDSRCPTQGEATLPEEQDQNYVCKHTYVDRGWGNGCGLFGKGSLVTCAKFQCLEPIEGKVVQYENLKYTVIITVHTGDQHQVGNDTQGVTVEITPQASTVEAVLPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCLNTFVLKKEVSETQHGTILIKVEYKGEDAPCKIPFSTEDGQGKAHNGRLITANPVVTKKEEPVNIEAEPPFGESNIVIGIGDKALKINWYKKGSSIGKMFEATARGARRMAILGDTAWDFGSVGGVLNSLGKMVHQIFGSAYTALFSGVSWIMKIGIGVLLTWIGLNSKNTSMSFSCIVIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSASRAWNVWEVEDYGFGVFTTNIWLKLREVYTQSCDHRLMSAAIKDERAVHADMGYWIESQKNGSWKLEKASFIEVKTCTWPKSHTLWSNGVLESDMIIPKSLAGPISQHNHRPGYHTQTTGPWHLGKLELDFNYCEGTTVVITENCGTRGPSLRTTTVSGKLIHEWCCRSCTLPPLRYMGEDGCWYGMEIRPINEKEENMVKSLVSAGSGKVDNFTMGVLCLAILFEEVMRGKFGKKHMIAGVLFTFVLLLSGQITWRDMAHTLIMIGSNASDRMGMGVTYLALIATFKIQPFLALGFFLRKLTSRENLLLGVGLAMATTLQLPEDIEQMANGIALGLMTLKLITQFETYQLWTALVSLTCSNTIFTLTVAWRTATLILAGVSLLPLCQSSSMRKTDWLPMTVAAMGVPPLPLFIFSLKDTPKRRSWPLNEGVMAVGLVSILASSLLRNDVPMAGPLVAGGLLIACYVITGTSADLTVEKAADVTWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTHNGKRLEPNWASVKKDLISYGGGWRLSAQWQKGEEVQVIAVEPGKNPKNFQTMPGIFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLVIMDEAHFTDPASIAARGYISTRVGMGEAAAIFMTATPPGTAEAFPQSNAPIQDEERDIPERSWNSGNEWITDFVGKTVWFVPSIKAGNDIANCLRKNGKKVIQLSRKTFDTEYQKTRLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGERNNQILEENMDVEIWTKEGERKKLRPRWLDARTYSDPLALKEFKDFAAGRKSIALDLVTEIGRVPSHLAHRTRNALDNLVMLHTSEHGGRAYRHAVEELPETMETLLLLGLMILLTGGAMLFLISGKGIGKTSIGLICVIVSSGMLWMADVPLQWIASAIVLEFFMMVLLIPEPEKQRTPQDNQLAYVVIGILTLAAIVAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLVTHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGRRGTGSQGETLGEKWKKKLNQLSRKEFDLYKKSGITEVDRTEAKEGLKRGETTHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLRNNQFCIKVLNPYMPTVIEHLERLQRKYGGMLVRNPLSRNSTHEMYWISNGTGNIVSSVNMVSRLLLNRFTMTHRRPTIEKDVDLGAGTRHVNAEPETPNMDVIGERIKRIKEEHSSTWHYDDENPYKTWAYHGSYEVKATGSASSMINGVVKLLTKPWDVVPMVTQMAMTDTTPFGQQRVFKEKVDTRTPRPMPGTRKVMEITAEWLWRTLGRNKKPRLCTREEFTKKVRTNAAMGAVFTEENQWDSARAAVEDEEFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPKGTVMDIISRKDQRGSGQVGTYGLNTFTNMEAQLVRQMEGEGVLSKADLENPHLLEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLKETACLGKAYAQMWSLMYFHRRDLRLASNAICSAVPVHWIPTSRTTWSIHAHHQWMTTEDMLTVWNRVWIEDNPWMEDKTPVTTWEDVPYLGKREDQWCGSLIGLTSRATWAQNILTAIQQVRSLIGDEEFLDYMPSMKRFRKEEESEGAIW

SEQ ID NO: 4699 - protein, 3290 aa, Artificial Sequence
  derived and/or modified protein sequence (wt) from DENV-3__FJ639725__SS-prME
TSLCLMMMLPATLAFHLTSRDGEPRMIVGKNERGKSLLFKTASGINMCTLIAMDLGEMCDDTVTYKCPLIAEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKSKPTLDIELQKTEATQLATLRKLCIEGKITNITTDSRCPTQGEATLPEEQDQNYVCKHTYVDRGWGNGCGLFGKGSLVTCAKFQCLEPIEGKVVQYENLKYTVIITVHTGDQHQVGNDTQGVTVEITPQASTVEAVLPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCLNTFVLKKEVSETQHGTILIKVEYKGEDAPCKIPFSTEDGQGKAHNGRLITANPVVTKKEEPVNIEAEPPFGESNIVIGIGDKALKINWYKKGSSIGKMFEATARGARRMAILGDTAWDFGSVGGVLNSLGKMVHQIFGSAYTALFSGVSWIMKIGIGVLLTWIGLNSKNTSMSFSCIVIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSASRAWNVWEVEDYGFGVFTTNIWLKLREVYTQSCDHRLMSAAIKDERAVHADMGYWIESQKNGSWKLEKASFIEVKTCTWPKSHTLWSNGVLESDMIIPKSLAGPISQHNHRPGYHTQTAGPWHLGKLELDFNYCEGTTVVITENCGTRGPSLRTTTVSGKLIHEWCCRSCTLPPLRYMGEDGCWYGMEIRPINEKEENMVKSLVSAGSGKVDNFTMGVLCLAILFEEVMRGKFGKKHMIAGVLFTFVLLLSGQITWRDMAHTLIMIGSNASDRMGMGVTYLALIATFKIQPFLALGFFLRKLTSRENLLLGVGLAMATTLQLPEDIEQMANGIALGLMTLKLITQFETYQLWTALVSLTCSNTIFTLTVAWRTATLILAGVSLLPLCQSSSMRKTDWLPMTVAAMGVPPLPLFIFSLKDTPKRRSWPLNEGVMAVGLVSILASSLLRNDVPMAGPLVAGGLLIACYVITGTSADLTVEKAADVTWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTHNGKRLEPNWASVKKDLISYGGGWRLSAQWQKGEEVQVIAVEPGKNPKNFQTMPGIFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLVIMDEAHFTDPASIAARGYISTRVGMGEAAAIFMTATPPGTAEAFPQSNAPIQDEERDIPERSWNSGNEWITDFVGKTVWFVPSIKAGNDIANCLRKNGKKVIQLSRKTFDTEYQKTRLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGERNNQILEENMDVEIWTKEGERKKLRPRWLDARTYSDPLALKEFKDFAAGRKSIALDLVTEIGRVPSHLAHRTRNALDNLVMLHTSEHGGRAYRHAVEELPETMETLLLLGLMILLTGGAMLFLISGKGIGKTSIGLICVIASSGMLWMADVPLQWIASAIVLEFFMMVLLIPEPEKQRTPQDNQLAYVVIGILTLAAIVAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLVTHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGRRGTGSQGETLGEKWKKKLNQLSRKEFDLYKKSGITEVDRTEAKEGLKRGETTHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLRNNQFCIKVLNPYMPTVIEHLERLQRKYGGMLVRNPLSRNSTHEMYWISNGTGNIVSSVNMVSRLLLNRFTMTHRRPTIEKDVDLGAGTRHVNAEPETPNMDVIGERIKRIKEEHSSTWHYDDENPYKTWAYHGSYEVKATGSASSMINGVVKLLTKPWDVVPMVTQMAMTDTTPFGQQRVFKEKVDTRTPRPMPGTRKVMEITAEWLWRTLGRNKKPRLCTREEFTKKVRTNAAMGAVFTEENQWDSARAAVEDEEFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPKGTVMDIISRKDQRGSGQVGTYGLNTFTNMEAQLVRQMEGEGVLSKADLENPHLLGKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLKETACLGKAYAQMWSLMYFHRRDLRLASNAICSAVPVHWIPTSRTTWSIHAHHQWMTTEDMLTVWNRVWIEDNPWMEDKTPVTTWEDVPYLGKREDQWCGSLIGLTSRATWAQNILTAIQQVRSLIGDEEFLDYMPSMKRFRKEEESEGAIW

SEQ ID NO: 4700 - protein, 3290 aa, Artificial Sequence
  derived and/or modified protein sequence (wt) from DENV-3__FJ639726__SS-prME
TSLCLMMMLPATLAFHLTSRDGEPRMIVGKNERGKSLLFKTASGINMCTLIAMDLGEMCDDTVTYKCPLIAEVEPEDIDCWCNLTSTWVTYGTCNQAGEHRRDKRSVALAPHVGMGLDTRTQTWMSAEGAWRQVERVETWALRHPGFTILALFLAHYIGTSLTQKVVIFILLMLVTPSMTMRCVGVGNRDFVEGLSGATWVDVVLEHGGCVTTMAKSKPTLDIELQKTEATQLATLRKLCIEGKITNITTDSRCPTQGEATLPEEQDQNYVCKHTYVDRGWGNGCGLFGKGSLVTCAKFQCLEPIEGKVVQYENLKYTVIITVHTGDQHQVGNDTQGVTVEITPQASTVEAVLPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCLNTFVLKKEVSETQHGTILIKVEYKGEDAPCKIPFSTEDGQGKAHNGRLITANPVVTKKEEPVNIEAEPPFGESNIVIGIGDKALKINWYKKGSSIGKMFEATARGARRMAILGDTAWDFGSVGGVLNSLGKMVHQIFGSAYTALFSGVSWIMKIGIGVLLTWIGLNSKNTSMSFSCIVIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSASRAWNVWEVEDYGFGVFTTNIWLKLREVYTQSCDHRLMSAAIKDERAVHADMGYWIESQKNGSWKLEKASFIEVKTCTWPKSHTLWSNGVLESDMIIPKSLAGPISQHNHRPGYHTQTAGPWHLGKLELDFNYCEGTTVVITENCGTRGPSLRTTTVSGKLIHEWCCRSCTLPPLRYMGEDGCWYGMEIRPINEKEENMVKSLVSAGSGKVDNFTMGVLCLAILFEEVMRGKFGKKHMIAGVLFTFVLLLSGQITWRDMAHTLIMIGSNASDRMGMGVTYLALIATFKIQPFLALGFFLRKLTSRENLLLGVGLAMATTLQLPEDIEQMANGIALGLMTLKLITQFETYQLWTALVSLTCSNTIFTLTVAWRTATLILAGVSLLPLCQSSSMRKTDWLPMTVAAMGVPPLPLFIFSLKDTPKRRSWPLNEGVMAVGLVSILASSLLRNDVPMAGPLVAGGLLIACYVITGTSADLTVEKAADVTWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTHNGKRLEPNWASVKKDLISYGGGWRLSAQWQKGEEVQVIAVEPGKNPKNFQTMPGIFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLVIMDEAHFTDPASIAARGYISTRVGMGEAAAIFMTATPPGTAEAFPQSNAPIQDEERDIPERSWNSGNEWITDFVGKTVWFVPSIKAGNDIANCLRKNGKKVIQLSRKTFDTEYQKTRLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGERNNQILEENMDVEIWTKEGERKKLRPRWLDARTYSDPLALKEFKDFAAGRKSIALDLVTEIGRVPSHLAHRTRNALDNLVMLHTSEHGGRAYRHAVEELPETMETLLLLGLMILLTGGAMLFLISGKGIGKTSIGLICVIVSSGMLWMADVPLQWIASAIVLEFFMMVLLIPEPEKQRTPQDNQLAYVVIGILTLAAIVAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLVTHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGRRGTGSQGETLGEKWKKKLNQLSRKEFDLYKKSGITEVDRTEAKEGLKRGETTHHAVSRGSAKLQWFVERNMVIPEGRVIDLGCGRGGWSYYCAGLKKVTEVRGYTKGGPGHEEPVPMSTYGWNIVKLMSGKDVFYLSPEKCDTLLCDIGESSPSPTVEESRTIRVLKMVEPWLRNNQFCIKVLNPYMPTVIEHLERLQRKYGGMLVRNPLSRNSTHEMYWISNGTGNIVSSVNMVSRLLLNRFTMTHRRPTIEKDVDLGAGTRHVNAEPETPNMDVIGERIKRIKEEHSSTWHYDDENPYKTWAYHGSYEVKATGSASSMINGVVKLLTKPWDVVPMVTQMAMTDTTPFGQQRVFKEKVDTRTPRPMPGTRKVMEITAEWLWRTLGRNKKPRLCTREEFTKKVRTNAAMGAVFTEENQWDSARAAVEDEEFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPKGTVMDIISRKDQRGSGQVGTYGLNTFTNMEAQLVRQMEGEGVLSKADLENPHLLEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLKETACLGKAYAQMWSLMYFHRRDLRLASNAICSAVPVHWIPTSRTTWSIHAHHQWMTTEDMLTVWNRVWIEDNPWMEDKTPVTTWEDVPYLGKREDQWCGSLIGLTSRATWAQNILTAIQQVRSLIGDEEFLDYMPSMKRFRKEEESEGAIW

SEQ ID NO: 4701 - protein, 3290 aa, Artificial Sequence
  derived and/or modified protein sequence (wt) from DENV-3__KF955333__SS-prME
TSLCLMMMLPATLAFHLTSRDGEPRMIVGKNERGKSLLFKTASGINMCTLIAMDLGEMCDDTVTYKCPLIAEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKSKPTLDIELQKTEATQLATLRKLCIEGKITNITTDSRCPTQGEATLPEEQDQNYVCKHTYVDRGWGNGCGLFGKGSLVTCAKFQCLEPIEGKVVQYENLKYTVIITVHTGDQHQVGNDTQGVTVEITPQASTVEAVLPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCLNTFVLKKEVSETQHGTILIKVEYKGEDAPCKIPFSTEDGQGKAHNGRLITANPVVTKKEEPVNIEAEPPFGESNIVIGIGDKALKINWYKKGSSIGKMFEATARGARRMAILGDTAWDFGSVGGVLNSLGKMVHQIFGSAYTALFSGVSWIMKIGIGVLLTWIGLNSKNTSMSFSCIVIGIITLYLGAVVQADMGCAINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSASRAWNVWEVEDYGFGVFTTNIWLKLREVYTQSCDHRLMSAAIKDERAAHADMGYWIESQKNGSWKLEKASFIEVKTCTWPKSHTLWSNGVLESDMIIPKSLAGPISQHNHRPGYHTQTAGPWHLGKLELDFNYCEGTTVVITENCGTRGPSLRTTTVSGKLIHEWCCRSCTLPPLRYMGEDGCWYGMEIRPINEKEENMVKSLVSAGSGKVDNFTMGVLCLAILFEEVMRGKFGKKHMIAGVLFTFVLLLSGQITWRDMAHTLIMIGSNASDRMGMGVTYLALIATFKIQPFLALGFFLRKLTSRENLLLGVGLAMATTLQLPEDIEQMANGIALGLMTLKLITQFETYQLWTALVSLTCSNTIFTLTVAWRTATLILAGVSLLPLCQSSSMRKTDWLPMTVAAMGVPPLPLFIFSLKDTPKRRSWPLNEGVMAVGLVSILASSLLRNDVPMAGPLVAGGLLIACYVITGTSADLTVEKPADVPWEEEAEQTGVSHNLMITVDDDGPMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTHNGKRLEPNWASVKKDLISYGGGWRLNAQWQKGEEVQVIAVEPGKNPKNFQTMPGIFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLVIMDEAHFTDPASIAARGYISTRVGMGEAAAIFMTATPPGTAEAFPQSNAPIQDEERDIPERSWNSGNEWITDFVGKTVWFVPSIKAGNDIANCLRKNGKKVIQLSRKTFDTEYQKTRLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGERNNQILEENMDVEIWTKEGERKKLRPRWLDARTYSDPLALKEFKDFAAGRKSIALDLVTEIGRVPSHLAHRTRNALDNLVMLHTSEHGGRAYRHAVEELPETMETLLLLGLMILLTGGAMLFLISGKGIGKTSIGLICVIVSSGMLWMADVPLQWIASAIVLEFFMMVLLIPEPEKQRTPQDNQLAYVVIGILTLAAIVAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLVTHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGRRGTGSQGETLGEKWKKKLNQLSRKEFDLYKKSGITEVDRTEAKEGLKRGETTHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLRNNQFCIKVLNPYMPTVIEHLERLQRKYGGMLVRNPLSRNSTHEMYWISNGTGNIVSSVNMVSRLLLNRFTMTHRRPTIEKDVDLGAGTRHVNAEPETPNMDVIGERIKRIKEEHSSTWHYDDENPYKTWAYHGSYEVKATGSASSMINGVVKLLTKPWDVVPMVTQMAMTDTTPFGQQRVFKEKVDTRTPRPMPGTRKVMEITAEWLWRTLGRNKKPRLCTREEFTKKVRTNAAMGAVFTEENQWDSARAAVEDEEFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITAQMDPEHRQLANAIFKLTYQNKVVKVQRPTPKGTVMDIISRKDQRGSGQVGTYGLNTFTNMEAQLVRQMEGEGVLSKADLENPHLLEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLKETACLGKAYAQMWSLMYFHRRDLRLASNAICSAVPVHWIPTSRTTWSIHAHHQWMTTEDMLTVWNRVWIEDNPWMEDKTPVTTWEDVPYLGKREDQWCGSLIGLTSRATWAQNILTAIQQVRSLIGDEEFLDYMPSMKRFRKEEESEGAIW

SEQ ID NO: 4702 - protein, 3290 aa, Artificial Sequence
  derived and/or modified protein sequence (wt) from DENV-3__GQ868628__SS-prME
TSLCLMMMLPATLAFHLTSRDGEPRMIVGKNERGKSLLFKTASGINMCTLIAMDLGEMCDDTVTYKCPLIAEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKSKPTLDIELQKTEATQLATLRKLCIEGKITNITTDSRCPTQGEATLPEEQDQNYVCKHTYVDRGWGNGCGLFGKGSLVTCAKFQCLEPIEGKVVQYENLKYTVIITVHTGDQHQVGNDTQGVTVEITPQASTVEAVLPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCLNTFVLKKEVSETQHGTILIKVEYKGEDAPCKIPFSTEDGQGKAHNGRLITANPVVTKKEEPVNIEAEPPFGESNIVIGIGDKALKINWYKKGSSIGKMFEATARGARRMAILGDTAWDFGSVGGVLNSLGKMVHQIFGSAYTALFSGVSWIMKIGIGVLLTWIGLNSKNTSMSFSCIVIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSASRAWNVWEVEDYGFGVFTTNIWLKLREVYTQSCDHRLMSAAIKDERAVHADMGYWIESQKNGSWKLEKASFIEVKTCAWPKSHTLWSNGVLESDMIIPKSLAGPISQHNHRPGYHTQTAGPWHLGKLELDFNYCEGTTVVITENCGTRGPSLRTTTVSGKLIHEWCCRSCTLPPLRYMGEDGCWYGMEIRPINEKEENMVKSLVSAGSGKVDNFTMGVLCLAILFEEVMRGKFGKKHMIAGVLFTFVLLLSGQITWRDMAHTLIMIGSNASDRMGMGVTYLALIATFKIQPFLALGFFLRKLTSRENLLLGVGLAMATTLQLPEDIEQMANGIALGLMTLKLITQFETYQLWTALVSLTCSNTIFTLTVAWRTATLILAGVSLLPLCQSSSMRKTDWLPMTVAAMGVPPLPLFIFSLKDTPKRRSWPLNEGVMAVGLVSILASSLLRNDVPMAGPLVAGGLLIACYVITGTSADLTVEKAADVTWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTHNGKRLEPNWASVKKDLISYGGGWRLSAQWQKGEEVQVIAVEPGKNPKNFQTMPGIFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLVIMDEAHFTDPASIAARGYISTRVGMGEAAAIFMTATPPGTAEAFPQSNAPIQDEERDIPERSWNSGNEWITDFVGKTVWFVPSIKAGNDIANCLRKNGKKVIQLSRKTFDTEYQKTRLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGERNNQILEENMDVEIWTKEGERKKLRPRWLDARTYSDPLALKEFKDFAAGRKSIALDLVTEIGRVPSHLAHRTRNALDNLVMLHTSEHGGRAYRHAVEELPETMETLLLLGLMILLTGGAMLFLISGKGIGKTSIGLICVIVSSGMLWMADVPLQWIASAIVLEFFMMVLLIPEPEKQRTPQDNQLAYVVIGILTLAAIVAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLVTHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGRRGTGSQGETLGEKWKKKLNQLSRKEFDLYKKSGITEVDRTEAKEGLKRGETTHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLRNNQFCIKVLNPYMPTVIEHLERLQRKYGGMLVRNPLSRNSTHEMYWISNGTGNIVSSVNMVSRLLLNRFTMTHRRPTIEKDVDLGAGTRHVNAEPETPNMDVIGERIKRIKEEHSSTWHYDDENPYKTWAYHGSYEVKATGSASSMINGVVKLLTKPWDVVPMVTQMAMTDTTPFGQQRVFKEKVDTRTPRPMPGTRKVMEITAEWLWRTLGRNKKPRLCTREEFTKKVRTNAAMGAVFTEENQWDSARAAVEDEEFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPKGTVMDIISRKDQRGSGQVGTYGLNTFTNMEAQLVRQMEGEGVLSKADLENPHLLEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLKETACLGKAYAQMWSLMYFHRRDLRLASNAICSAVPVHWIPTSRTTWSIHAHHQWMTTEDMLTVWNRVWIEDNPWMEDKTPVTTWEDVPYLGKREDQWCGSLIGLTSRATWAQNILTAIQQVRSLIGDEEFLDYMPSMKRFRKEEESEGAIW

SEQ ID NO: 4703 - protein, 3290 aa, Artificial Sequence
  derived and/or modified protein sequence (wt) from DENV-3__FJ639727__SS-prME
TSLCLMMMLPATLAFHLTSRDGEPRMIVGKNERGKSLLFKTASGINMCTLIAMDLGEMCDDTVTYKCPLIAEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKSKPTLDIELQKTEATQLATLRKLCIEGKITNITTDSRCPTQGEATLPEEQDQNYVCKHTYVDRGWGNGCGLFGKGSLVTCAKFQCLEPIEGKVVQYENLKYTVIITVHTGDQHQVGNDTQGVTVEITPQASTVEAVLPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCLNTFVLKKEVSETQHGTILIKVEYKGEDAPCKIPFSTEDGQGKSHNGRLITANPVVTKKEEPVNIEAEPPFGESNIVIGIGDKALKINWYKKGSSIGKMFEATARGARRMAILGDTAWDFGSVGGVLNSLGKMVHQIFGSAYTALFSGVSWIMKIGIGVLLTWIGLNSKNTSMSFSCIVIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSASRAWNVWEVEDYGFGVFTTNIWLKLREVYTQSCDHRLMSAAIKDERAVHADMGYWIESQKNGSWKLEKASFIEVKTCTWPKSHTLWSNGVLESDMIIPKSLAGPISQHNHRPGYYTQTAGPWHLGKLELDFNYCEGTTVVITENCGTRGPSLRTTTVSGKLIHEWCCRSCTLPPLRYMGEDGCWYGMEIRPINEKEENMVKSLVSAGSGKVDNFTMGVLCLAILFEEVMRGKFGKKHMIAGALFTFVLLLSGQITWRDMAHTLIMIGSNASDRMGMGVTYLALIATFKIQPFLALGFFLRKLTSRENLLLGVGLAMATTLQLPEDIEQMANGIALGLMTLKLITQFETYQLWTALVSLTCSNTIFTLTVAWRTATLILAGVSLLPLCQSSSMRKTDWLPMTVAAMGVPPLPLFIFSLKDTPKRRSWPLNEGVMAVGLVSILASSLLRNDVPMAGPLVAGGLLIACYVITGTSADLTVEKAADVTWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTHNGKRLEPNWASVKKDLISYGGGWRLSAQWQKGEEVQVIAVEPGKNPKNFQTMPGIFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLVVMDEAHFTDPASIAARGYISTRVGMGEAAAIFMTATPPGTAEAFPQSNAPIQDEERDIPERSWNSGNEWITDFVGKTVWFVPSIKAGNDIANCLRKNGKKVIQLSRKTFDTEYQKTRLNDWDFVVTTDISEMGANFRADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGERNNQILEENMDVEIWTKEGERKKLRPRWLDARTYSDPLALKEFKDFAAGRKSIALDLVTEIGRVPSHLAHRTRNALDNLVMLHTSEHGGRAYRHAVEELPETMETLLLLGLMILLTGGAMLFLISGKGIGKTSIGLICVIVSSGMLWMADVPLQWIASAIVLEFFMMVLLIPEPEKQRTPQDNQLAYVVIGILTLAAIVAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLVTHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGRRGTGSQGETLGEKWKKKLNQLSRKEFDLYKKSGITEVDRTEAKEGLKRGETTHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLRNNQFCIKVLNPYMPTVIEHLERLQRKYGGMLVRNPLSRNSTHEMYWISNGTGNIVSSVNMVSRLLLNRFTMTHRRPTIEKDVDLGAGTRHVNAEPETPNMDVIGERIKRIKEEHSSTWHYDDENPYKTWAYHGSYEVKATGSASSMINGVVKLLTKPWDVVPMVTQMAMTDTTPFGQQRVFKEKVDTRTPRPMPGTRKVMEITAEWLWRTLGRNKKPRLCTREEFTKKVRTNAAMGAVFTEENQWDSARAAVEDEEFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPKGTVMDIISRKDQRGSGQVGTYGLNTFTNMEAQLVRQMEGEGVLSKADLENPHLLEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLKETACLGKAYAQMWSLMYFHRRDLRLASNAICSAVPVHWIPTSRTTWSIHAHHQWMTTEDMLTVWNRVWIEDNPWMEDKTPVTTWEDVPYLGKREDQWCGSLIGLTSRATWAQNILTAIQQVRSLIGDEEFLDYMPSMKRFRKEEESEGAIW

SEQ ID NO: 4704 - protein, 3290 aa, Artificial Sequence
  derived and/or modified protein sequence (wt) from DENV-3__GQ868629__SS-prME
TSLCLMMMLPATLAFHLTSRDGEPRMIVGKNERGKSLLFKTASGINMCTLIAMDLGEMCDDTVTYKCPLIAEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKSKPTLDIELQKTEATQLATLRKLCIEGKITNITTDSRCPTQGEATLPEEQDQNYVCKHTYVDRGWGNGCGLFGKGSLVTCAKFQCLEPIEGKVVQYENLKYTVIITVHTGDQHQVGNDTQGVTVEITPQASTVEAVLPEYGTLGLECSPRTGLDFNEMILLTMKNKAWMVHRQWFFDLPLPWTSGAITETPTWNRKELLVTFKNAHAKKQEVVVLGSQEGAMHTALTGATEIQNSGGTSIFAGHLKCRLKMDKLELKGMSYAMCLNTFVLKKEVSETQHGTILIKVEYKGEDAPCKIPFSTEDGQGKAHNGRLITANPVVTKKEEPVNIEAEPPFGESNIVIGIGDKALKINWYKKGSSIGKMFEATARGARRMAILGDTAWDFGSVGGVLNSLGKMVHQIFGSAYTALFSGVSWIMKIGIGVLLTWIGLNSKNTSMSFSCIVIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSASRAWNVWEVEDYGFGVFTTNIWLKLREVYTQSCDHRLMSAAIKDERAVHADMGYWIESQKNGSWKLEKASFIEVKTCTWPKSHTLWSNGVLESDMIIPKSLAGPISQHNHRPGYHTQTAGPWHLGKLELDFNYCEGTTVVITENCGTRGPSLRTTTVSGKLIHEWCCRSCTLPPLRYMGEDGCWYGMEIRPINEKEENMVKSLVSAGSGKVDNFTMGVLCLAILFEEVMRGKFGKKHMIAGVLFTFVLLLSGQITWRDMAHTLIMIGSNASDRMGMGVTYLALIATFKIQPFLALGFFLRKLTSRENLLLGVGLAMATTLQLPEDIEQMANGIALGLMTLKLITQFETYQLWTALVSLTCSNTIFTLTVAWRTATLILAGVSLLPLCQSSSMRKTDWLPMTVAAMGVPPLPLFIFSLKDTPKRRSWPLNEGVMAVGLVSILASSLLRNDVPMAGPLVAGGLLIACYVITGTSADLTVEKAADVTWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTHNGKRLEPNWASVKKDLISYGGGWRLSAQWQKGEEVQVIAVEPGKNPKNFQTMPGIFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLVIMDEAHFTDPASIAARGYISTRVGMGEAAAIFMTATPPGTAEAFPQSNAPIQDEERDIPERSWNSGNEWITDFVGKTVWFVPSIKAGNDIANCLRKNGKKVIQLSRKTFDTEYQKTRLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGERNNQILEENMDVEIWTKEGERKKLRPRWLDARTYSDPLALKEFKDFAAGRKSIALDLVTEIGRVPSHLAHRTRNALDNLVMLHTSEHGGRAYRHAVEELPETMETLLLLGLMILLTGGAMLFLISGKGIGKTSIGLICVIVSSGMLWMADVPLQWIASAIVLEFFMMVLLIPEPEKQRTPQDNQLAYVVIGILTLAAIVAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLVTHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGRRGTGSQGETLGEKWKKKLNQLSRKEFDLYKKSGITEVDRTEAKEGLKRGETTHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLRNNQFCIKVLNPYMPTVIEHLERLQRKYGGMLVRNPLSRNSTHEMYWISNGTGNIVSSVNMVSRLLLNRFTMTHRRPTIEKDVDLGAGTRHVNAEPETPNMDVIGERIKRIKEEHSSTWHYDDENPYKTWAYHGSYEVKATGSASSMINGVVKLLTKPWDVVPMVTQMAMTDTTPFGQQRVFKEKVDTRTPRPMPGTRKVMEITAEWLWRTLGRNKKPRLCTREEFTKKVRTNAAMGAVFTEENQWDSARAAVEDEEFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPKGTVMDIISRKDQRGSGQVGTYGLNTFTNMEAQLVRQMEGEGVLSKADLENPHLLEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLKETACLGKAYAQMWSLMYFHRRDLRLASNAICSAVPVHWIPTSRTTWSIHAHHQWMTTEDMLTVWNRVWIEDNPWMEDKTPVTTWEDVPYLGKREDQWCGSLIGLTSRATWAQNILTAIQQVRSLIGDEEFLDYMPSMKRFRKEEESEGAIW

SEQ ID NO: 4705 - protein, 3290 aa, Artificial Sequence
  derived and/or modified protein sequence (wt) from DENV-3__FJ639728__SS-prME
TSLCLMMMLPATLAFHLTSRDGEPRMIVGKNERGKSLLFKTASGINMCTLIAMDLGEMCDDTVTYKCPLIAEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKSKPTLDIELQKTEATQLATLRKLCIEGKITNITTDSRCPTQGEATLPEEQDQNYVCKHTYVDRGWGNGCGLFGKGSLVTCAKFQCLEPIEGKVVQYENLKYTVIITVHTGDQHQVGNDTQGVTVEITPQASTVEAVLPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCLNTFVLKKEVSETQHGTILIKVEYKGEDAPCKIPFSTEDGQGKAHNGRLITANPVVTKKEEPVNIEAEPPFGESNIVIGIGDKALKINWYKKGSSIGKMFEATARGARRMAILGDTAWDFGSVGGVLNSLGKMVHQIFGSAYTALFSGVSWIMKIGIGVLLTWIGLNSKNTSMSFSCIVIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSALRAWNVWEVEDYGFGVFTTNIWLKLREVYTQSCDHRLMSAAIKDERAVHADMGYWIESQKNGSWKLEKASFIEVKTCTWPKSHTLWSNGVLESDMIIPKSLAGPISQHNHRPGYHTQTAGPWHLGKLELDFNYCEGTTVVITENCGTRGPSLRTTTVSGKLIHEWCCRSCTLPPLRYMGEDGCWYGMEIRPINEKEENMVKSLVSAGSGKVDNFTMGVLCLAILFEEVMRGKFGKKHMIAGVLFTFVLLLSGQITWRDMAHTLIMIGSNASDRMGMGVTYLALIATFKIQPFLALGFFLRKLTSRENLLLGVGLAMATTLQLPEDIEQMANGIALGLMTLKLITQFETYQLWTALVSLTCSNTIFTLTVAWRTATLILAGVSLLPLCQSSSMRKTDWLPMTVAAMGVPPLPLFIFSLKDTPKRRSWPLNEGVMAVGLVSILASSLLRNDVPMAGPLVAGGLLIACYVITGTSADLTVEKAADVTWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTHNGKRLEPNWASVKKDLISYGGGWRLSAQWQKGEEVQVIAVEPGKNPKNFQTMPGIFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLVIMDEAHFTDPASIAARGYISTRVGMGEAAAIFMTATPPGTAEAFPQSNAPIQDEERDIPERSWNSGNEWITDFVGKTVWFVPSIKAGNDIANCLRKNGKKVIQLSRKTFDTEYQKTRLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGERNNQILEENMDVEIWTKEGERKKLRPRWLDARTYSDPLALKEFKDFAAGRKSIALDLVTEIGRVPSHLAHRTRNALDNLVMLHTSEHGGRAYRHAVEELPETMETLLLLGLMILLTGGAMLFLISGKGIGKTSIGLICVIVSSGMLWMADVPLQWIASAIVLEFFMMVLLIPEPEKQRTPQDNQLAYVVIGILTLAAIVAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLVTHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGRRGTGSQGETLGEKWKKKLNQLSRKEFDLYKKSGITEVDRTEAKEGLKRGETTHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLRNNQFCIKVLNPYMPTVIEHLERLQRKYGGMLVRNPLSRNSTHEMYWISNGTGNIVSSVNMVSRLLLNRFTMTHRRPTIEKDVDLGAGTRHVNAEPETPNMDVIGERIKRIKEEHSSTWHYDDENPYKTWAYHGSYEVKATGSASSMINGVVKLLTKPWDVVPMVTQMAMTDTTPFGQQRVFKEKVDTRTPRPMPGTRKVMEITAEWLWRTLGRNKKPRLCTREEFTKKVRTNAAMGAVFTEENQWDSARAAVEDEEFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPKGTVMDIISRKDQRGSGQVGTYGLNTFTNMEAQLVRQMEGEGVLSKADLENPHLLEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLKETACLGKAYAQMWSLMYFHRRDLRLASNAICSAVPVHWIPTSRTTWSIHAHHQWMTTEDMLTVWNRVWIEDNPWMEDKTPVTTWEDVPYLGKREDQWCGSLIGLTSRATWAQNILTAIQQVRSLIGDEEFLDYMPSMKRFRKEEESEGAIW

SEQ ID NO: 4706 - protein, 3290 aa, Artificial Sequence
  derived and/or modified protein sequence (wt) from DENV-3__FJ639729__SS-prME
TSLCLMMMLPATLAFHLTSRDGEPRMIVGKNERGKSLLFKTASGINMCTLIAMDLGEMCDDTVTYKCPLIAEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKSKPTLDIELQKTEATQLATLRKLCIEGKITNITTDSRCPTQGEATLPEEQDQNYVCKHTYVDRGWGNGCGLFGKGSLVTCAKFQCLEPIEGKVVQYENLKYTVIITVHTGDQHQVGNDTQGVTVEITPQASTVEAVLPEYGTLGLECSPRTGLDFNEMILLTMKNKAWMVHRQWFFDLPLPWTSGAITETPTWNRKELLVTFKNAHAKKQEVVVLGSQEGAMHTALTGATEIQNSGGTSIFAGHLKCRLKMDKLELKGMSYAMCLNTFVLKKEVSETQHGTILIKVEYKGEDAPCKIPFSTEDGQGKAHNGRLITANPVVTKKEEPVNIEAEPPFGESNIVIGIGDKALKINWYKKGSSIGKMFEATARGARRMAILGDTAWDFGSVGGVLNSLGKMVHQIFGSAYTALFSGVSWIMKIGIGVLLTWIGLNSKNTSMSFSCIVIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSASRAWNVWEVEDYGFGVFTTNIWLKLREVYTQSCDHRLMSAAIKDERAVHADMGYWIESQKNGSWKLEKASFIEVKTCTWPKSHTLWSNGVLESDMIIPKSLAGPISQHNHRPGYHTQTAGPWHLGKLELDFNYCEGTTVVITENCGTRGPSLRTTTVSGKLIHEWCCRSCTLPPLRYMGEDGCWYGMEIRPINEKEENMVKSLVSAGSGKVDNFTMGVLCLAILFEEVMRGKFGKKHMIAGVLFTFVLLLSGQITWRDMAHTLIMIGSNASDRMGMGVTYLALIATFKIQPFLALGFFLRKLTSRENLLLGVGLAMATTLQLPEDIEQMANGIALGLMTLKLITQFETYQLWTALVSLTCSNTIFTLTVAWRTATLILAGVSLLPLCQSSSMRKTDWLPMTVAAMGVPPLPLFIFSLKDTPKRRSWPLNEGVMAVGLVSILASSLLRNDVPMAGPLVAGGLLIACYVITGTSADLTVEKAADVTWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTHNGKRLEPNWASVKKDLISYGGGWRLSAQWQKGEEVQVIAVEPGKNPKNFQTMPGIFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLVIMDEAHFTDPASIAARGYISTRVGMGEAAAIFMTATPPGTAEAFPQSNAPIQDEERDIPERSWNSGNEWITDFVGKTVWFVPSIKAGNDIANCLRKNGKKVIQLSRKTFDTEYQKTRLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGERNNQILEENMDVEIWTKEGERKKLRPRWLDARTYSDPLALKEFKDFAAGRKSIALDLVTEIGRVPSHLAHRTRNALDNLVMLHTSEHGGRAYRHAVEELPETMETLLLLGLMILLTGGAMLFLISGKGIGKTSIGLICVIVSSGMLWMADVPLQWIASAIVLEFFMMVLLIPEPEKQRTPQDNQLAYVVIGILTLAAIVAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLVTHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGRRGTGSQGETLGEKWKKKLNQLSRKEFDLYKKSGITEVDRTEAKEGLKRGETTHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLRNNQFCIKVLNPYMPTVIEHLERLQRKYGGMLVRNPLSRNSTHEMYWISNGTGNIVSSVNMVSRLLLNRFTMTHRRPTIEKDVDLGAGTRHVNAEPETPNMDVIGERIKRIKEEHSSTWHYDDENPYKTWAYHGSYEVKATGSASSMINGVVKLLTKPWDVVPMVTQMAMTDTTPFGQQRVFKEKVDTRTPRPMPGTRKVMEITAEWLWRTLGRNKKPRLCTREEFTKKVRTNAAMGAVFTEENQWDSARAAVEDEEFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPKGTVMDIISRKDQRGSGQVGTYGLNTFTNMEAQLVRQMEGEGVLSKADLENPHLLEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLKETACLGKAYAQMWNLMYFHRRDLRLASNAICSAVPVHWIPTSRTTWSIHAHHQWMTTEDMLTVWNRVWIEDNPWMEDKTPVTTWEDVPYLGKREDQWCGSLIGLTSRATWAQNILTAIQQVRSLIGDEEFLDYMPSMKRFRKEEESEGAIW

SEQ ID NO: 4707 - protein, 3290 aa, Artificial Sequence
  derived and/or modified protein sequence (wt) from DENV-3__FJ639730__SS-prME
TSLCLMMMLPATLAFHLTSRDGEPRMIVGKNERGKSLLFKTASGINMCTLIAMDLGEMCDDTVTYKCPLIAEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKSKPTLDIELQKTEATQLATLRKLCIEGKITNITTDSRCPTQGEATLPEEQDQNYVCKHTYVDRGWGNGCGLFGKGSLVTCAKFQCLEPIEGKVVQYENLKYTVIITVHTGDQHQVGNDTQGVTVEITPQASTVEAVLPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCLNTFVLKKEVSETQHGTILIKVEYKGEDAPCKIPFSTEDGQGKAHNGRLITANPVVTKKEEPVNIEAEPPFGESNIVIGIGDKALKINWYKKGSSIGKMFEATARGARRMAILGDTAWDFGSVGGVLNSLGKMVHQIFGSAYTALFSGVSWIMKIGIGVLLTWIGLNSKNTSMSFSCIVIGIITLYLGAVVQADMGCAINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSASRAWNVWEVEDYGFGVFTTNIWLKLREVYTQSCDHRLMSAAIKDEKAVHADMGYWIESQKNGSWKLEKASFIEVKTCTWPKSHTLWSNGVLESDMIIPKSLAGPISQHNHRPGYHTQTAGPWHLGKLELDFNYCEGTTVVITENCGTRGPSLRTTTVSGKLIHEWCCRSCTLPPLRYMGEDGCWYGMEIRPINEKEENMVKSLVSAGSGKVDNFTMGVLCLAILFEEVMRGKFGKKHMIAGVLFTFVLLLSGQITWRDMAHTLIMIGSNASDRMGMGVTYLALIATFKIQPFLALGFFLRKLTSRENLLLGVGLAMATTLQLPEDIEQMANGIALGLMTLKLITQFETYQLWTALVSLTCSNTIFTLTVAWRTATLILAGVSLLPLCQSSSMRKTDWLPMTVAAMGVPPLPLFIFSLKDTPKRRSWPLNEGVMAVGLVSILASSLLRNDVPMAGPLVAGGLLIACYVITGTSADLTVEKAADVTWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTHNGKRLEPNWASVKKDLISYGGGWRLNAQWQKGEEVQVIAVEPGKNPKNFQTMPGIFQTTTGEIGAIALDFKPGTSGSPIINKEGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLVIMDEAHFTDPASIAARGYISTRVGMGEAAAIFMTATPPGTAEAFPQSNAPIQDEERDIPERSWNSGNEWITDFVGKTVWFVPSIKAGNDIANCLRKNGKKVIQLSRKTFDTEYQKTRLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGERNNQILEENMDVEIWTKEGERKKLRPRWLDARTYSDPLALKEFKDFAAGRKSIALDLVTEIGRVPSHLAHRTRNALDNLVMLHTSEHGGRAYRHAVEELPETMETLLLLGLMILLTGGAMLFLISGKGIGKTSIGLICVIVSSGMLWMADVPLQWIASAIVLEFFMMVLLIPEPEKQRTPQDNQLAYVVIGILTLAAIVAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLVTHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGRRGTGSQGETLGEKWKKKLNQLSRKEFELYKKSGITEVDRTEAKEGLKRGETTHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLRNNQFCIKVLNPYMPTVIEHLEKLQRKYGGMLVRNPLSRNSTHEMYWISNGTGNIVSSVNMVSRLLLNRFTMTHRRPTIEKDVDLGAGTRHVNAEPETPNMDVIGERIKRIKEEHSSTWHYDDENPYKTWAYHGSYEVKATGSASSMINGVVKLLTKPWDVVPMVTQMAMTDTTPFGQQRVFKEKVDTRTPRPMPGTRKVMEITAEWLWRTLGRNKKPRLCTREEFTKKVRTNAAMGAVFTEENQWDSARAAVEDEEFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPKGTVMDIISRKDQRGSGQVGTYGLNTFTNMEAQLVRQMEGEGVLSKADLENPHLLEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLKETACLGKAYAQMWSLMYFHRRDLRLASNAICSAVPVHWIPTSRTTWSIHAHHQWMTTEDMLTVWNRVWIEDNPWMEDKTPVTTWEDVPYLGKREDQWCGSLIGLTSRATWAQNILTAIQQVRSLIGDEEFLDYMPSMKRFRKEEESEGAIW

SEQ ID NO: 4708 - protein, 3290 aa, Artificial Sequence
  derived and/or modified protein sequence (wt) from DENV-3__KF955464__SS-prME
TSLCLMMMLPATLAFHLTSRDGEPRMIVGKNERGKSLLFKTASGINMCTLIAMDLGEMCDDTVTYKCPLIAEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKSKPTLDIELQKTEATQLAILRKLCIEGKITNITTDSRCPTQGEATLPEEQDQNYVCKHTYVDRGWGNGCGLFGKGSLVTCAKFQCLEPIEGKVVQYENLKYTVIITVHTGDQHQVGNDTQGVTVEITPQASTVEAVLPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTNIFAGHLKCRLKMDKLELKGMSYAMCLNTFVLKKEVSETQHGTILIKVEYKGEDAPCKIPFSTEDGQGKAHNGRLITANPVVTKKEEPINIEAEPPFGESNIVIGIGDKALKINWYKKGSSIGKMFEATARGARRMAILGDTAWDFGSVGGVLNSLGKMVHQIFGSAYTALFSGVSWIMKIGIGVLLTWIGLNSKNTSMSFSCIVIGIITLYLGAVVQADMGCVINWKGKELKCGNGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSASRAWNVWEVEDYGFGVFTTNIWLKLREVYTQSCDHRLMSAAIKDERAVHADMGYWIESQKNGSWKLEKASFIEVKTCTWPKSHTLWSNGVLESDMIIPKSLAGPISQHNHRPGYHTQTAGPWHLGKLELDFNYCEGTTVVIAENCGTRGPSLRTTTVSGKLIHEWCCRSCTLPPLRYMGEDGCWYGMEIRPINEKEENMVKSLVSAGSGKVDNFTMGVLCLAILFEEVMRGKFGKKHMIAGVLFTFVLLLSGQITWRDMAHTLIMIGSNASDRMGMGVTYLALIATFKIQPFLALGFFLRKLTSRENLLLGVGLAMATTLQLPEDIEQMANGIALGLMTLKLITQFETYQLWTALVSLTCSNTIFTLTVAWRTATLILAGVSLLPLCQSSSMRKTDWLPMTVAAMGVPPLPLFIFSLKDTPKRKSWPLNEGVMAVGLVSILASSLLRNDVPMAGPLVAGGLLIACYVITGTSADLTVEKAADVTWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTHNGKRLEPNWASVKKDLISYGGGWRLSAQWQKGEEVQVIAVEPGKNPKNFQTMPGIFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTAEAFPQSNAPIQDEERDIPERSWNSGNEWITDFVGKTVWFVPSIKAGNDIANCLRKNGKKVIQLSRKTFDTEYQKTRLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGERNNQILEENMDVEIWTKEGERKKLRPRWLDARTYSDPLALKEFKDFAAGRKSIALDLVTEIGRVPSHLAHRTRNALDNLVMLHTSEHGGRAYRHAVEELPETMETLLLLGLMILLTGGAMLFLISGKGIGKTSIGLICVIVSSGMLWMADVPLQWIASAIVLEFFMMVLLIPEPEKQRTPQDNQLAYVVIGILTLAAIVAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLVTHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGRRGTGSQGETLGEKWKKKLNQLSRKEFDLYKKSGITEVDRTEAKEGLKRGETTHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLRMVEPWLRNNQFCIKVLNPYMPNVIEHLERLQRKYGGMLVRNPLSRNSTHEMYWISNGTGNIVSSVNMVSRLLLNRFTMTHRRPTIEKDVDLGAGTRHVNAEPETPNMDVIGERIKRIKEEHSSTWHYDDENPYKTWAYHGSYEVKATGSASSMINGVVKLLTKPWDVVPMVTQMAMTDTTPFGQQRVFKEKVDTRTPRPMPGTRKVMEITAEWLWRTLGRNKKPRLCTREEFTKKVRTNAAMGAVFTEENQWDSARAAVEDEEFWKLVDKERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPKGTVMDIISRKDQRGSGQVGTYGLNTFTNMEAQLVRQMEGEGVLSEADLENPHLLEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLKETACLGKAYAQMWSLMYFHRRDLRLASNAICSAVPAHWIPTSRTTWSIHAHHQWMTTEDMLTVWNRVWIEDNPWMEDKTPVTTWEDVPYLGKREDQWCGSLIGLTSRATWAQNILTAIQQVRSLIGDEEFLDYMPSMKRFRKEEESEGAIW

SEQ ID NO: 4709 - protein, 3290 aa, Artificial Sequence
  derived and/or modified protein sequence (wt) from DENV-3__FJ639731__SS-prME
TSLCLMMMLPATLAFHLTSRDGEPRMIVGKNERGKSLLFKTASGINMCTLIAMDLGEMCDDTVTYKCPLIAEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKSKPTLDIELQKTEATQLATLRKLCIEGKITNITTDSRCPTQGEATLPEEQDQNYVCKHTYVDRGWGNGCGLFGKGSLVTCAKFQCLEPIEGKVVQYENLKYTVIITVHTGDQHQVGNDTQGVTVEITPQASTVEAVLPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCLNTFVLKKEVSETQHGTVLIKVEYKGEDAPCKIPFSTEDGQGKAHNGRLITANPVVTKKEEPVNIEAEPPFGESNIVIGIGDKALKINWYKKGSSIGKMFEATARGARRMAILGDTAWDFGSVGGVLNSLGKMVHQIFGSAYTALFSGVSWIMKIGIGVLLTWIGLNSKNTSMSFSCIVIGIITLYLGAVVQADMGCAINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSASRAWNVWEVEDYGFGVFTTNIWLKLREVYTQSCDHRLMSAAIKDERAVHADMGYWIESQKNGSWKLEKASFIEVKTCTWPKSHTLWSNGVLESDMIIPKSLAGPISQHNHRPGYHTQTAGPWHLGKLELDFNYCEGTTVVITENCGTRGPSLRTTTVSGKLIHEWCCRSCTLPPLRYMGEDGCWYGMEIRPINEKEENMVKSLVSAGSGKMDNFTMGVLCLAILFEEVMRGKFGKKHMIAGVLFTFVLLLSGQITWRDMAHTLIMIGSNASDRMGMGVTYLALIATFKIQPFLALGFFLRKLTSRENLLLGVGLAMATTLQLPEDIEQMANGIALGLMTLKLITQFETYQLWTALVSLTCSNTIFTLTVAWRTATLILAGVSLLPLCQSSSMRKTDWLPMTVAAMGVPPLPLFIFSLKDTPKRRSWPLNEGVMAVGLVSILASSLLRNDVPMAGPLVAGGLLIACYVITGTSADLTVEKAADVTWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTHNGKRLEPNWASVKKDLISYGGGWRLNAQWQKGEEVQVIAVEPGKNPKNFQTMPGIFQTTTGEIGAIALDFKPGTSGSPIINKEGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLVIMDEAHFTDPASIAARGYISTRVGMGEAAAIFMTATPPGTAEAFPQSNAPIQDEERDIPERSWNSGNEWITDFVGKTVWFVPSIKAGNDIANCLRKNGKKVIQLSRKTFDTEYQKTRLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGERNNQILEENMDVEIWTKEGERKKLRPRWLDARTYSDPLALKEFKDFAAGRKSIALDLVTEIGRVPSHLAHRTRNALDNLVMLHTSEHGGRAYRHAVEELPETMETLLLLGLMILLTGGAMLFLISGKGIGKTSIGLICVIVSSGMLWMADVPLQWIASAIVLEFFMMVLLIPEPEKQRTPQDNQLAYVVIGILTLAAIVAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLVTHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGRRGTGSQGETLGEKWKKKLNQLSRKEFDLYKKSGITEVDRTEAKEGLKRGETTHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLRNNQFCIKVLNPYMPTVIEHLERLQRKYGGMLVRNPLSRNSTHEMYWISNGTGNIVSSVNMVSRLLLNRFTMTHRRPTIEKDVDLGAGTRHVNAEPETPNMDVIGERIKRIKEEHSSTWHYDDENPYKTWAYHGSYEVKATGSASSMINGVVKLLTKPWDVVPMVTQMAMTDTTPFGQQRVFKEKVDTRTPRPMPGTRKVMEITAEWLWRTLGRNKKPRLCTREEFTKKVRTNAAMGAVFTEENQWDSARAAVEDEEFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPKGTVMDIISRKDQRGSGQVGTYGLNTFTNMEAQLVRQMEGEGVLSKADLENPHLLEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLKETACLGKAYAQMWSLMYFHRRDLRLASNAICSAVPVHWIPTSRTTWSIHAHHQWMTTEDMLTVWNRVWIEDNPWMEDKTPVTTWEDVPYLGKREDQWCGSLIGLTSRATWAQNILTAIQQVRSLIGDEEFLDYMPSMKRFRKEEESEGAIW

SEQ ID NO: 4710 - protein, 3290 aa, Artificial Sequence
  derived and/or modified protein sequence (wt) from DENV-3__HM181933__SS-prME
TSLCLMMMLPATLAFHLTSRDGEPRMIVGKNERGKSLLFKTASGINMCTLIAMDLGEMCDDTVTYKCPLIAEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKSKPTLDIELQKTEATQLATLRKLCIEGKITNITTDSRCPTQGEATLPEEQDQNYVCKHTYVDRGWGNGCGLFGKGSLVTCAKFQCLEPIEGKVVQYENLKYTVIITVHTGDQHQVGNDTQGVTVEITPQASTVEAVLPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCLNTFVLKKEVSETQHGTILIKVEYKGEDAPCKIPFSTEDGQGKAHNGRLITANPVVTKKEEPVNIEAEPPFGESNIVIGIGDKALKINWYKKGSSIGKMFEATARGARRMAILGDTAWDFGSVGGVLNSLGKMVHQIFGSAYTALFSGVSWIMKIGIGVLLTWIGLNSKNTSMSFSCIVIGIITLYLGAVVQADMGCAINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSASRAWNVWEVEDYGFGVFTTNIWLKLREVYTQSCDHRLMSAAIKDERAVHADMGYWIESQKNGSWKLEKASFIEVKTCTWPKSHTLWSNGVLESDMIIPKSLAGPISQHNHRPGYHTQTAGPWHLGKLELDFNYCEGTTVVITENCGTRRPSLRTTTVSGKLIHEWCCRSCTLPPLRYMGEDGCWYGMEIRPINEKEENMVKSLVSAGSGKVDNFTMGVLCLAILFEEVMRGKFGKKHMIAGVLFTFVLLLSGQITWRDMAHTLIMIGSNASDRMGMGVTYLALIATFKIQPFLALGFFLRKLTSRENLLLGVGLAMATTLQLPEDIEQMANGIALGLMTLKLITQFETYQLWTALVSLTCSNTIFTLTVAWRTATLILAGVSLLPLCQSSSMRKTDWLPMTVAAMGVPPLPLFIFSLKDTPKRRSWPLNEGVMAVGLVSILASSLLRNDVPMAGPLVAGGLLIACYVITGTSADLTVEKAADVTWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTHNGKRLEPNWASVKKDLISYGGGWRLNAQWQKGEEVQVIAVEPGKNPKNFQTMPGIFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLVIMDEAHFTDPASIAARGYISTRVGMGEAAAIFMTATPPGTAEAFPQSNAPIQDEERDIPERSWNSGNEWITDFVGKTVWFVPSIKAGNDIANCLRKNGKKVIQLSRKTFDTEYQKTRLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGERNNQILEENMDVEIWTKEGERKKLRPRWLDARTYSDPLALKEFKDFAAGRKSIALDLVTEIGRVPSHLAHRTRNALDNLVMLHTSEHGGRAYRHAVEELPETMETLLLLGLMILLTGGAMLFLISGKGIGKTSIGLICVIVSSGMLWMADVPLQWIASAIVLEFFMMVLLIPEPEKQRTPQDNQLAYVVIGILTLAAIVAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLVTHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGRRGTGSQGETLGEKWKKKLNQLSRKEFDLYKKSGITEVDRTEAKEGLKRGETTHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLRNNQFCIKVLNPYMPTVIEHLERLQRKYGGMLVRNPLSRNSTHEMYWISNGTGNIVSSVNMVSRLLLNRFTMTHRRPTIEKDVDLGAGTRHVNAEPETPNMDVIGERIKRIKEEHSSTWHYDDENPYKTWAYHGSYEVKATGSASSMINGVVKLLTKPWDVVPMVTQMAMTDTTPFGQQRVFKEKVDTRTPRPMPGTRKVMEITAEWLWRTLGRNKKPRLCTREEFTKKVRTNAAMGAVFTEENQWDSARAAVEDEEFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPKGTVMDIISRKDQRGSGQVGTYGLNTFTNMEAQLVRQMEGEGVLSKADLENPHLLEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLKETACLGKAYAQMWSLMYFHRRDLRLASNAICSAVPVHWIPTSRTTWSIHAHHQWMTTEDMLTVWNRVWIEDNPWMEDKTPVTTWEDVPYLGKREDQWCGSLIGLTSRATWAQNILTAIQQVRSLIGDEEFLDYMPSMKRFRKEEESEGAIW

SEQ ID NO: 4711 - protein, 3290 aa, Artificial Sequence
  derived and/or modified protein sequence (wt) from DENV-3__JF295012__SS-prME
TSLCLMMMLPATLAFHLTSRDGEPRMIVGKNERGKSLLFKTASGINMCTLIAMDLGEMCDDTVTYKCPLIAEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKSKPTLDIELQKTEATQLATLRKLCIEGKITNITTDSRCPTQGEATLPEEQDQNYVCKHTYVDRGWGNGCGLFGKGSLVTCAKFQCLEPIEGKVVQYENLKYTVIITVHTGDQHQVGNDTQGVTVEITPQASTVEAVLPEYGTLGLECSPRTGLDFNEMILLTMKNKAWMVHRQWFFDLPLPWTSGATTETPTWNKKELLVTFKNAHAKKQEVVVLGSQEGAMHTALTGATEIQNSGGTSIFAGHLKCRLKMDKLELKGMSYAMCLNTFVLKKEVSETQHGTILIKVEYKGEDAPCKIPFSTEDGQGKAHNGRLITANPVVTKKEEPVNIEAEPPFGESNIVIGIGDKALKINWYKKGSSIGKMFEATARGARRMAILGDTAWDFGSVGGVLNSLGKMVHQIFGSAYTALFSGVSWIMKIGIGVLLTWIGLNSKNTSMSFSCIVIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSASRAWNVWEVEDYGFGVFTTNIWLKLREVYTQSCDHRLMSAAIKDERAVHADMGYWIESQKNGSWKLEKASFIEVKTCTWPKSHTLWSNGVLESDMIIPKSLAGPISQHNHRPGYHTQTAGPWHLGKLELDFNYCEGTTVVITENCGTRGPSLRTTTVSGKLIHEWCCRSCTLPPLRYMGEDGCWYGMEIRPINEKEENMVKSLVSAGSGKVDNFTMGVLCLAILFEEVMRGKFGKKHMIAGVLFTFVLLLSGQITWRDMAHTLIMIGSNASDRMGMGVTYLALIATFKIQPFLALGFFLRKLTSRENLLLGVGLAMATTLQLPEDIEQMANGIALGLMTLKLITQFETYQLWTALVSLTCSNTIFTLTVAWRTATLILAGVSLLPLCQSSSMRKTDWLPMTVAAMGVPPLPLFIFSLKDTPKRRSWPLNEGVMAVGLVSILASSLLRNDVPMAGPLVAGGLLIACYVITGTSADLTVEKAADVTWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTHNGKRLEPNWASVKKDLISYGGGWRLSAQWQKGEEVQVIAVEPGKNPKNFQTMPGIFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLVIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGERNNQILEENMDVEIWTKEGERKKLRPRWLDARTYSDPLALKEFKDFAAGRKSIALDLVTEIGRVPSHLAHRTRNALDNLVMLHTSEHGGRAYRHAVEELPETMETLLLLGLMILLTGGAMLFLISGKGIGKTSIGLICVIVSSGMLWMADVPLQWIASAIVLEFFMMVLLIPEPEKQRTPQDNQLAYVVIGILTLAAIVAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLVTHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGRRGTGSQGETLGEKWKKKLNQLSRKEFDLYKKSGITEVDRTEAKEGLKRGETTHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLRNNQFCIKVLNPYMPTVIEHLERLQRKYGGMLVRNPLSRNSTHEMYWISNGTGNIVSSVNMVSRLLLNRFTMTHRRPTIEKDVDLGAGTRHVNAEPETPNMDVIGERIKRIKEEHSSTWHYDDENPYKTWAYHGSYEVKATGSASSMINGVVKLLTKPWDVVPMVTQMAMTDTTPFGQQRVFKEKVDTRTPRPMPGTRKVMEITAEWLWRTLGRNKKPRLCTREEFTKKVRTNAAMGAVFTEENQWDSARAAVEDEEFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPKGTVMDIISRKDQRGSGQVGTYGLNTFTNMEAQLVRQMEGEGVLSKADLENPHLLEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLKETACLGKAYAQMWSLMYFHRRDLRLASNAICSAVPVHWIPTSRTTWSIHAHHQWMTTEDMLTVWNRVWIEDNPWMEDKTPVTTWEDVPYLGKREDQWCGSLIGLTSRATWAQNILTAIQQVRSLIGDEEFLDYMPSMKRFRKEEESEGAIW

SEQ ID NO: 4712 - protein, 3290 aa, Artificial Sequence
  derived and/or modified protein sequence (wt) from DENV-3__FJ898463__SS-prME
TSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSTEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAVLPEEQDQNYVCKHTYVDRGWGNGCGLFGKGSLVTCAKFQCLEPIEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDAPCKIPFSTEDGQGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSASRAWNVWEVEDYGFGVFTTNIWLKLREVYTQLCDHRLMSAAVKDERAVHADMGYWIESQKNGSWKLEKASLIEVKTCTWPKSHTLWSNGVLESDMIIPKSLAGPISQHNHRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGKVDNFTMGVLCLAILFEEVMRGKFGKKHMIAGVFFTFVLLLSGQITWRDMAHTLIMIGSNASDRMGMGVTYLALIATFKIQPFLALGFFLRKLTSRENLLLGVGLAMATTLQLPEDIEQMANGIALGLMALKLITQFETYQLWTALISLTCSNTMFTLTVAWRTATLILAGVSLLPVCQSSSMRKTDWLPMAVAAMGVPPLPLFIFSLKDTLKRRSWPLNEGVMAVGLVSILASSLLRNDVPMAGPLVAGGLLIACYVITGTSADLTVEKAADITWEEEAEQTGVSHNLMITVDDDGTMRIKDDETENILTVLLKTALLIVSGVFPYSIPATLLVWHTWQKQTQRSGVLWDVPSPPETQKAELEEGVYRIKQQGIFGKTQVGVGVQKEGVFHTMWHVTRGAVLTYNGKRLEPNWASVKKDLISYGGGWRLSAQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNSQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKDFAAGRKSIALDLVTEIGRVPSHLAHRTRNALDNLVMLHTSEHGGRAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGETTHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVASVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRSMPGTRRVMGITAEWLWTTLGRNKKPRLCTREEFTKKVRTNAAMGAVFTEENQWDSAKAAVEDEDFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPTGTVMDIISRKDQRGSGQVGTYGLNTFTNMEAQLIRQMEGEGVLSKADLENPHLPEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLRETACLGKAYAQMWSLMYFHRRDLRLASNAICSAVPVHWVPTSRTTWSIHAHHQWMTTEDMLTVWNRVWIEDNPWMEDKTPVTTWENVPYLGKREDQWCGSLIGLTSRATWAQNIPTAIQQVRSLIGNEEFLDYMPSMKRFRKEEESEGAIW

SEQ ID NO: 4713 - protein, 3290 aa, Artificial Sequence
  derived and/or modified protein sequence (wt) from DENV-3__GQ868616__SS-prME
TSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSTEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAVLPEEQDQNYVCKHTYVDRGWGNGCGLFGKGSLVTCAKFQCLEPIEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDAPCKIPFSTEDGQGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSASRAWNVWEVEDYGFGVFTTNIWLKLREVYTQLCDHRLMSAAVKDERAVHADMGYWIESQKNGSWKLEKASLIEVKTCTWPKSHTLWSNGVLESDMIIPKSLAGPISQHNHRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGKVDNFTMGVLCLAILFEEVMRGKFGKKHMIAGVFFTFVLLLSGQITWRDMAHTLIMIGSNASDRMGMGVTYLALIATFKIQPFLALGFFLRKLTSRENLLLGVGLAMATTLQLPEDIEQMANGIALGLMALKLITQFETYQLWTALISLTCSNTMFTLTVAWRTATLILAGVSLLPVCQSSSMRKTDWLPMAVAAMGVPPLPLFIFSLKDTLKRRSWPLNEGVMAVGLVSILASSLLRNDVPMAGPLVAGGLLIACYVITGTSADLTVEKAADITWEEEAEQTGVSHNLMITVDDDGTMRIKDDETENILTVLLKTALLIVSGVFPYSIPATLLVWHTWQKQTQRSGVLWDVPSPPETQKAELEEGVYRIKQQGIFGKTQVGVGVQKEGVFHTMWHVTRGAVLTYNGKRLEPNWASVKKDLISYGGGWRLSAQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNSQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKDFAAGRKSIALDLVTEIGRVPSHLAHRTRNALDNLVMLHTSEHGGRAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIALDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGETTHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVASVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRSMPGTRRVMGITPEWLWRPLGRNKKPRLCPREEFTKKVRTNAPMGAVFTEETQWASAKAAVEDEDFWKLVDRERELHKLGKCGSCVYNMMGKREKKLGEFGKAKGSRAIWYMWLGARYLEFEALGFLNEDHWFSRENSYSGVEGEGLPKLGYILRDISKIPGGAMYADDTAGWDTRITEDDLHNEEKITQQMDPEHRQLANAIFKLTYQNKVVKVQRPTPTGTVMDIISRKDQRGSGQVGTYGLNTFTNMEAQLIRQMEGEGVLSKADLENPHLPEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLRETACLGKAYAQMWSLMYFHRRDLRLASNAICSAVPVHWVPTSRTTWSIHAHHQWMTTEDMLTVWNRVWIEDNPWMEDKTPVTTWENVPYLGKREDQWCGSLIGLTSRATWAQNIPTAIQQVRSLIGNEEFLDYMPSMKRFRKEEESEGAIW

SEQ ID NO: 4714 - protein, 3290 aa, Artificial Sequence
  derived and/or modified protein sequence (wt) from DENV-3__GQ199887__SS-prME
TSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAVLPEEQDQNYVCKHTYVDRGWGNGCGLFGKGSLVTCAKFQCLESIEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILVKVEYKGEDAPCKIPFSTEDGQGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDTIGVLEQGKRTLTPQPMELKYSWKTWGKAKIVTAEIQNSSFIIDGPNTPECPSASRAWNVWEVEDYGFGVFTTNIWLKLREVYTQLCDHRLMSAAVKDERAVHADMGYWIESQKNGSWKLEKASFIEVKTCTWPKSHTLWSNGVLESDMIIPKSLAGPISQHNYRPGYHTQTAGPWHLGKLELDFNYCEGTTVVITENCGTRGPSLRTTTVSGKLIHEWCCRSCTLPPLRYMGEDGCWYGMEIRPISEKEENMVKSLASAGSGKVDNFTMGVLCLAILFEEVMRGKFGKKHMIAGVFFTFVLLLSGQITWRDMAHTLIMIGSNASDRMGMGVTYLALIATFKIQPFLALGFFLRKLTSRENLLLGVGLAMATTLQLPEDIEQMANGIALGLMALKLITQFETYQLWTALVSLTCSNTMFTLTVAWRTATLILAGVSLLPVCQSSSMRKTDWLPMTVAAMGVPPLPLFIFSLKDTLKRRSWPLNEGVMAVGLVSILASSLLRNDVPMAGPLVAGGLLIACYVITGTSADLTVEKAADVTWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGILGKTQVGVGVQKEGVFHTMWHVTRGAVLTHNGKRLEPNWASVKKDLISYGGGWRLSAQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFRKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKDFAAGRKSIALDLVTEIGRVPSHLAHRTRNALDNLVMLHTSEHGGRAYRHAVEELPETMETLLLLGLMILLTGGVMLFLISGKGIGKTSIGLICVIASSGMLWMADVPLQWIASAIVLEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGETTHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVSSVNMVSRLLLNRFTMTHRRPTIERDVDLGAGTRHVNAEPEIPNMDVIGERIKRIKEEHNSTWHYDDENPYKTWAYHGSYEVKATGSASSMINGVVKLLTKPWDVVPMVTQMAMTDTTPFGQQRVFKEKVDTRTPRPMPGTRKVMEITAEWLWRTLGRNKRPRLCTREEFTKKVRTNAAMGAVFTEENQWDSAKAAVEDEEFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPTGTVMDIISRKDQRGSGQVGTYGLNTFTNMEAQLVRQMEGEGVLSKADLENPHLLEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLRETACLGKAYAQMWSLMYFHRRDLRLASNAICSAVPVHWVPTSRTTWSIHAHHQWMTTEDMLTVWNRVWIEDNPWMEDKTPVTTWENVPYLGKREDQWCGSLIGLTSRATWAQNIPTAIQQVRSLIGNEEFLDYMPSMKRFRKEEESEGAIW

SEQ ID NO: 4715 - protein, 3290 aa, Artificial Sequence
  derived and/or modified protein sequence (wt) from DENV-3__GQ199888__SS-prME
TSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAVLPEEQDQNYVCKHTYVDRGWGNGCGLFGKGSLVTCAKFQCLESIEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILVKVEYKGEDAPCKIPFSTEDGQGKAHNGRLITANPVVTKKEEPVNIEAEPPFGESNIVIGTGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDTIGVLEQGKRTLTPQPMELKYSWKTWGKAKIVTAEIQNSSFIIDGPNTPECPSASRAWNVWEVEDYGFGVFTTNIWLKLREVYTQLCDHRLMSAAVKDERAVHADMGYWIESQKNGSWKLEKASFIEVKTCTWPKSHTLWSNGVLESDMIIPKSLAGPISQHNYRPGYHTQTAGPWHLGKLELDFNYCEGTTVVITENCGTRGPSLRTTTVSGKLIHEWCCRSCTLPPLRYMGEDGCWYGMEIRPISEKEENMVKSLASAGSGKVDNFTMGVLCLAILFEEVMRGKFGKKHMIAGVFFTFVLLLSGQITWRDMAHTLIMIGSNASDRMGMGVTYLALIATFKIQPFLALGFFLRKLTSRENLLLGVGLAMATTLQLPEDIEQMANGIALGLMALKLITQFETYQLWTALVSLTCSNTMFTLTVAWRTATLILAGVSLLPVCQSSSMRKTDWLPMTVAAMGVPPLPLFIFSLKDTLKRRSWPLNEGVMAVGLVSILASSLLRNDVPMAGPLVAGGLLIACYVITGTSADLTVEKAADVTWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGILGKTQVGVGVQKEGVFHTMWHVTRGAVLTHNGKRLEPNWASVKKDLISYGGGWRLSAQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFRKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKDFAAGRKSIALDLVTEIGRVPSHLAHRTRNALDNLVMLHTSEHGGRAYRHAVEELPETMETLLLLGLMILLTGGAMLFLISGKGIGKTSIGLICVIASSGMLWMADVPLQWIASAIVLEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGETTHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVSSVNMVSRLLLNRFTMTHRRPTIERDVDLGAGTRHVNAEPEIPNMDVIGERIKRIKEEHNSTWHYDDENPYKTWAYHGSYEVKATGSASSMINGVVKLLTKPWDVVPMVTQMAMTDTTPFGQQRVFKEKVDTRTPRPMPGTRKVMEITAEWLWRTLGRNKRPRLCTREEFTKKVRTNAAMGAVFTEENQWDSAKAAVEDEEFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPTGTVMDIISRKDQRGSGQVGTYGLNTFTNMEAQLVRQMEGEDVLSKADLENPHLLEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLRETACLGKAYAQMWSLMYFHRRDLRLASNAICSAVPVHWVPTSRTTWSIHAHHQWMTTEDMLTVWNRVWIEDNPWMEDKTPVTTWENVPYLGKREDQWCGSLIGLTSRATWAQNIPTAIQQVRSLIGNEEFLDYMPSMKRFRKEEESEGAIW

SEQ ID NO: 4716 - protein, 3290 aa, Artificial Sequence
  derived and/or modified protein sequence (wt) from DENV-3__GQ252674__SS-prME
TSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGIGNRDFVEGLSGATWVDVVLEHGGCVTTMAKNKPTLDIELQKTEATQLATLRKLCIEGKITNITTDSRCPTQGEAVLPEEQDQNYVCKHTYVDRGWGNGCGLFGKGSLVTCAKFQCLEPIEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDAPCKIPFSTEDGQGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDTIGVLEQGKRTLTPQPMELKYSWKTWGKAKIVTAETQNSSFIIDGPNTPECPSASRAWNVWEVEDYGFGVFTTNIWLKLRDVYTQLCDHRLMSAAVKDERAVHADMGYWIESQKNGSWKLEKASLIEVKTCTWPKSHTLWSNGVLESDMIIPKSLAGPISQHNYRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGKVDNFTMGVLCLAILFEEVMRGKFGKKHMIAGVLFTFVLLLSGQITWRDMAHTLIMIGSNASDRMGMGVTYLALIATFKIQPFLALGFFLRKLTSRENLLLGVGLAMATTLQLPEDIEQMANGIALGLMALKLITQFETYQLWTALVSLTCSNTILTLTVAWRTATLILAGVSLLPVCQSSSMRKTDWLPMTVAAMGVPPLPLFIFSLKDTLKRRSWPLNEGVMAVGLVSILASSLLRNDVPMAGPLVAGGLLIACYVITGTSADLTVENAADVTWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTHNGKRLEPNWASVKKDLISYGGGWRLSAQWQRGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPIPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKDFAAGRKSIALDLVTEIGRVPSHLAHRTRNALDNLVMLHTSEHGGRAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVSSVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRSMPGTRKVMGITAEWLWRTLGRNKRPRLCTREEFTKKVRTNAAMGAVFTEENQWDSAKAAVEDEEFWKLVDRERELHKLGKCGSCVYNMMGKREKKLGEFGKAKGSRAIWYMWLGARYLEFEALGFLNEDHWFSRDNSYSGVEGEGLHKLGYILRDISKIPGGAMYADDTAGWDTRITEDDLHNEEKITQQMDPEHRQLANAIFKLTYQNKVVKVQRPTPTGTVMDIISRKDQRGSGQVGTYGLNTFTNMEVQLVRQMEGEGVLSKADLENPHLPEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLRETACLGKAYAQMWSLMYFHRRDLRLASNAICSAVPVHWVPTSRTTWSIHAHHQWMTTEDMLTVWNRVWIEDNPWMENKTPVTTWENVPYLGKREDQWCGSLIGLTSRATWAQNIPTAIQQVRSLIGNEEFLDYMPSMKRFRKEEESEGAIW

SEQ ID NO: 4717 - protein, 3290 aa, Artificial Sequence
  derived and/or modified protein sequence (wt) from DENV-3__GQ199889__SS-prME
TSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLILVTPSMAMRCVGVGNRDFVEGLSGATWVDVVLEHGGCVTTMAKNKPTLDIELQKTEATQLATLRKLCIEGKITNITTDSRCPTQGEAILPEEQDQNYVCKHTYVDRGWGNGCGLFGKGSLVTCAKFQCLESIEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDAPCKIPFSTEDGQGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQADTGCVINWKGKELKCGSGIFVTNEVHTWTEQYKFQADSPKRLATAIAGAWENGVCGIRSTTRMENLLWKQIANELNYILWENNIKLTVVVGDTIGVLEQGKRTLTPQPMELKYSWKTWGKAKIVTAEIQNSSFIIDGPNTPECPSASRAWNVWEVEDYGFGVFTTNIWLKLREVYTQLCDHRLMSAAVKDERAVHADMGYWIESQKNGSWKLEKASFIEVKTCTWPKSHTLWSNGVLESDMIIPKSLAGPISQHNYRPGYHTQTAGPWHLGKLELDFNYCEGTTVVITENCGTRGPSLRTTTVSGKLIHEWCCRSCTLPPLRYMGEDGCWYGMEIRPISEKEENMVKSLASAGSGKVDNFTMGVLCLAILFEEVMRGKFGKKHMIAGVFFTFVLLLSGQITWRDMAHTLIMIGSNASDRMGMGVTYLALIATFKIQPFLALGFFLRKLTSRENLLLGVGLAMATTLQLPEDIEQMANGIALGLMALKLITQFETYQLWTALISLTCSNTMFTLTVAWRTATLILAGVSLLPVCQSSSMRKTDWLPMTVAAMGVPPLPLFIFSLKDTLKRRSWPLNEGVMAVGLVSILASSLLRNDVPMAGPLVAGGMLIACYVITGTSADLTVEKAADVTWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGILGKTQVGVGVQKEGVFHTMWHVTRGAVLTHNGKRLEPNWASVKKDLISYGGGWRLSAQWQKGEEVQVIAVEPGKNPKNFQTMPGTFQTTTGEIGAIALDFKPGTSGSPIINREGKVVGLYGNGVVTKNGGYVSGIAQTSAEPDGPTPELEEEMFRKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKDFAAGRKSIALDLVTEIGRVPSHLAHRTRNALDNLVMLHTSEHGGRAYRHAVEELPETMETLLLLGLMILLTGGAMLFLISGKGIGKTSIGLICVIASSGMLWMADVPLQWIASAIVLEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGETTRHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVSSVNMVSRLLLNRFTMTHRRPTIERDVDLGAGTRHVNAEPEIPNMDVIGERIKRIKEEHNSTWHYDDENPYKTWAYHGSYEVKATGSASSMINGVVKLLTKPWDVVPMVTQMAMTDTTPFGQQRVFKEKVDTRTPRPMPGTRKVMEITAEWLWRTLGRNKRPRLCTREEFTKKVRTNAAMGAVFTEENQWDSAKAAVEDEEFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPTGTVMDIISRKDQRGSGQVGTYGLNTFTNMEAQLVRQMEGEGVLSKADLENPHLLEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLRETACLGKAYAQMWSLMYFHRRDLRLASNAICSAVPVHWVPTSRTTWSIHAHHQWMTTEDMLTVWNRVWIEDNPWMEDKTPVTTWENVPYLGKREDQWCGSLIGLTSRATWAQNIPTAIQQVRSLIGNEEFLDYMPSMKRFRKEEESEGAIW

SEQ ID NO: 4718 - protein, 3290 aa, Artificial Sequence
  derived and/or modified protein sequence (wt) from DENV-3__FJ882571__SS-prME
TSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAVLPEEQDQNYVCKHTYVDRGWGNGCGLFGKGSLVTCAKFQCLEPIEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDAPCKIPFSTEDGQGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDTIGVLEQGKRTLTPQPMELKYSWKTWGKAKIVTAETQNSSFIIDGPNTPECPSASRAWNVWEVEDYGFGVFTTNIWLKLRDVYTQLCDHRLMSAAVKDERAVHADMGYWIESQKNGSWKLEKASLIEVKTCTWPKSHTLWSNGVLESDMIIPKSLAGPISQHNYRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGKVDNFTMGVLCLAILFEEVMRGKFGKKHMIAGVLFTFVLLLSGQITWRDMAHTLIMIGSNASDRMGMGVTYLALIATFKIQPFLALGFFLRKLTSRENLLLGVGLAMATTLQLPEDIEQMANGIALGLMALKLITQFETYQLWTALVSLTCSNTILTLTVAWRTATLILAGVSLLPVCQSSSMRKTDWLPMTVAAMGVPPLPLFIFSLKDTLKRRSWPLNEGVMAVGLVSILASSLLRNDVPMAGPLVAGGLLIACYVITGTSADLIVEKAADVTWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGILGKTQVGVGVQKEGVFHTMWHVTRGAVLTHNGKRLEPNWASVKKDLISYGGGWRLSAQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKDFAAGRKSIALDLVTEIGRVPSHLAHRTRNALDNLVMLHTSEHGGRAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVSSVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRPMPGTRKVMGITAEWLWRTLGRNKRPRLCTREEFTKKVRTNAAMGAVFTEENQWDSAKAAVEDEEFWKLVDRERELHKLGKCGSCVYNMMGKREKKLGEFGKAKGSRAIWYMWLGARYLEFEALGFLNEDHWFSRDNSYSGVEGEGLHKLGYILRDISKIPGGAMYADDTAGWDTRITEDDLHNEEKITQQMDPEHRQLANAIFKLTYQNKVVKVQRPTPTGTVMDIISRKDQRGSGQVGTYGLNTFTNMEVQLVRQMEGEGVLSKADLENPHLPEKKITQWLETKGVERLKRMAISGDDCVVKPIDDRFANALLALNDMGKVRKDIPQWQPSKGMHDWQQVPFCSHHFHELIMKDGRKLVVPCRPQDELIGRARISQGAGWSLRETACLGKAYAQMWSLMYFHRRDLRLASNAICSAVPVHWVPTSRTTWSIHAHHQWMTTEDMLAVWNRVWIEDNPWMEDKTPVTTWEDVPYLGKREDQWCGSLIGLTSRATWAQNILTAIQQVRSLIGNEEFLDYMPSMKRFRKEEESEGAIW

SEQ ID NO: 4719 - protein, 3290 aa, Artificial Sequence
  derived and/or modified protein sequence (wt) from DENV-3__FJ882572__SS-prME
TSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAVLPEEQDQNYVCKHTYVDRGWGNGCGLFGKGSLVTCAKFQCLESIEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDAPCKIPFSTEDGQGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQADTGCVINWKGKELKCGSGIFVTNEVHTWTEQYKFQADSPKRLATAIAGAWENGVCGIRSTTRMENLLWKQIANELNYILWENNIKLTVVVGDTIGVLEQGKRTLTPQPMELKYSWKTWGKAKIVTAEIQNSSFIIDGPNTPECPSASRAWNVWEVEDYGFGVFTTNIWLKLREVYTQLCDHRLMSAAVKDERAVHADMGYWIESQKNGSWKLEKASFIEVKTCTWPKSHTLWSNGVLESDMIIPKSLAGPISQHNYRPGYHTQTAGPWHLGKLELDFNYCEGTTVVITENCGTRGPSLRTTTVSGKLIHEWCCRSCTLPPLRYMGEDGCWYGMEIRPISEKEENMVKSLASAGSGKVDNFTMGVLCLAILFEEVMRGKFGKKHMIAGVFFTFVLLLSGQITWRDMAHTLIMIGSNASDRMGMGVTYLALIATFKIQPFLALGFFLRKLTSRENLLLGVGLAMATTLQLPEDIEQMANGIALGLMALKLITQFETYQLWTALISLTCSNTMFTLTVAWRTATLILAGVSLLPVCQSSSMRKTDWLPMTVAAMGVPPLPLFIFSLKDTLKRRSWPLNEGVMAVGLVSILASSLLRNDVPMAGPLVAGGMLIACYVITGTSADLTVEKAADVTWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGILGKTQVGVGVQKEGVFHTMWHVTRGAVLTHNGKRLEPNWASVKKDLISYGGGWRLSAQWQKGEEVQVIAVEPGKNPKNFQTMPGTFQTTTGEIGAIALDFKPGTSGSPIINREGKVVGLYGNGVVTKNGGYVSGIAQTSAEPDGPTPELEEEMFRKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKDFAAGRKSIALDLVTEIGRVPSHLAHRTRNALDNLVMLHTSEHGGRAYRHAVEELPETMETLLLLGLMILLTGGAMLFLISGKGIGKTSIGLICVIASSGMLWMADVPLQWIASAIVLEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGETTHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVSSVNMVSRLLLNRFTMTHRRPTIERDVDLGAGTRHVNAEPEIPNMDVIGERIKRIKEEHNSTWHYDDENPYKTWAYHGSYEVKATGSASSMINGVVKLLTKPWDVVPMVTQMAMTDTTPFGQQRVFKEKVDTRTPRPMPGTRKVMEITAEWLWRTLGRNKRPRLCTREEFTKKVRTNAAMGAVFTEENQWDSAKAAVEDEEFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPTGTVMDIISRKDQRGSGQVGTYGLNTFTNMEAQLVRQMEGEGVLSKADLENPHLLEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLRETACLGKAYAQMWSLMYFHRRDLRLASNAICSAVPVHWVPTSRTTWSIHAHHQWMTTEDMLTVWNRVWIEDNPWMEDKTPVTTWENVPYLGKREDQWCGSLIGLTSRATWAQNIPTAIQQVRSLIGNEEFLDYMPSMKRFRKEEESEGAIW

SEQ ID NO: 4720 - protein, 3290 aa, Artificial Sequence
  derived and/or modified protein sequence (wt) from DENV-3__FJ882573__SS-prME
TSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAVLPEEQDQNYVCKHTYVDRGWGNGCGLFGKGSLVTCAKFQCLEPIEGKVVQYENLKYTVIITVHTGDQHQVGNETQGVTAEITPQASTTEAILPEYGTLGLECSPRTGLDFNEMILLTMKNKAWMVHRQWFFDLPLPWASGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDAPCKIPFSTEDGQGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTPMSFSCIAIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDTTGVLEQGKRTLTPQPMELKYSWKTWGKAKIVTAETQNSSFIIDGPNTPECPSASRAWNVWEVEDYGFGVFTTNIWLKLREVYTQLCDHRLMSAAVKDERAVHADMGYWIESQKNGSWKLEKASLIEVKTCTWPKSHTLWSNGVLESDMIIPKSLAGPISQHNYRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGKVDNFTMGVLCLAILFEEVMRGKFGKKHMIAGVFFTFVLLLSGQITWRDMAHTLIMIGSNASDRMGMGVTYLALIATFKIQPFLALGFFLRKLTSRENLLLGVGLAMATTLQLPEDIEQMANGIALGLMALKLITQFETYQLWTALVSLTCSNTIFTLTVAWRTATLILAGVSLLPVCQSSSMRKTDWLPMTVAAMGVPPLPLFIFSLKDTLKRRSWPLNEGVMAVGLVSILASSLLRNDVPMAGPLVAGGLLIACYVITGTSADLTVEKAADVTWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGILGKTQVGVGVQKEGVFHTMWHVTRGAVLTHNGKRLEPNWASVKKDLISYGGGWRLSAQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKDFAAGRKSIALDLVTEIGRVPSHLAHRTRNALDNLVMLHTSEHGGRAYRHAVEELPETMETLLLLGLMILLTGGAMLFLISGKGIGKTSIGLICVIASSGMLWMAEVPLQWIASAIVLEFFMMVLLIPEPEKQRTPQDNQLAYVVIGILTLAAMIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGEITHHAVSRGSAKLQWFVERNMVVPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVSSVNMVSRLLLNRFTMTHRRPTIEKDVDLGAGTRHVNAEPETPNMDVIGERVKRIKEEHNSTWHYDDENPYKTWAYHGSYEVKATGSASSMINGVVKLLTKPWDVVPMVTQMAMTDTTPFGQQRVFKEKVDTRTPRPMPGTRKVMEITAEWLWRTLGRNKRPRLCTREEFTKKVRTNAAMGAVFTEENQWDSAKAAVEDEEFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKIIQQMDPEHRQLANAIFKLTYQNKVVKVQRPTPTGTVMDIISRKDQRGSGQVGTYGLNTFTNMEAQLVRQMEGEGVLTKADLENPHLLEKKITQWLEAKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLRETACLGKAYAQMWSLMYFHRRDLRLASNAICSAVPVHWVPTSRTTWSIHAHHQWMTTEDMLTVWNRVWIEENPWMEDKTPVTTWENVPYLGKREDQWCGSLIGLTSRATWAQNIPTAIQQVRSLIGNEEFLDYMPSMKRFRKEEESEGAIW

SEQ ID NO: 4721 - protein, 3290 aa, Artificial Sequence
  derived and/or modified protein sequence (wt) from DENV-3__FJ898440__SS-prME
TSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAVLPEEQDQNYVCKHTYVDRGWGNGCGLFGKGSLVTCAKFQCLEPIEGKVVQYENLKYTVIITVHTGDQHQVGNETQGVTAEITPQASITEAILPEYGTLGLECSPRTGLDFNEMVLLTMKNKAWMVHRQWFFDLPLPWTSGATTETPIWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDAPCKIPFSTEDGQGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQADTGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSASRAWNVWEVEDYGFGVFTTNIWLKLREVYTQLCDHRLMSAAVKDERAVHADMGYWIESQKNGSWKLEKASLIEVKTCTWPKSHTLWSNGVLESDMIIPKSLAGPISQHNYRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGKVDNFTMGVLCLAILFEEVMRGKFGKKHMIAGVFFTFVLLLSGQITWRDMAHTLIMIGSNASDRMGMGVTYLALIATFKIQPFLALGFFLRKLTSRENLLLGVGLAMATTLQLPEDIEQMANGIALGLMALKLITQFETYQLWTALISLTCSNTIFTLTVAWRTATLILAGVSLLPVCQSSSMRKTDWLPMTVAAMGVQPLPLFIFSLKDTLKRRSWPLNEGVMAVGLVSILASSLLRNDVPMAGPLVAGGLLIACYVITGTSADLTVEKAADVTWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTYNGKRLEPNWASVKKDLISYGGGWRLSAQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKDFAAGRKSIALDLVTEIGRVPSHLAHRTRNALDNLVMLHTSEHGGRAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAAIIAANEMGLLETTKKDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVASVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRSMPGTRRVMGITAEWLWRTLGRNKKPRLCTREEFTKKVRTNAAMGAVFTEENQWDSAKAAVEDEDFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMNPEHRQLANAIFKLTYQNKVVKVQRPTPTGTVMDIISRKDQRGSGQVGTYGLNTFTNMEAQLIRQMEGEGVLSKADLENPHLPEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLRETACLGKAYAQMWSLMYFHRRDLRLASNAICSAVPVHWVPTSRTTWSIHAHHQWMTTEDMLTVWNRVWIEDNPWMEDKTPVTTWENVPYLGKREDQWCGSLIGLTSRATWAQNIPTAIQQVRSLIGNEEFLDYMPSMKRFRKEEESEGAIW

SEQ ID NO: 4722 - protein, 3290 aa, Artificial Sequence
  derived and/or modified protein sequence (wt) from DENV-3__FJ898441__SS-prME
TSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAVLPEEQDQNYVCKHTYVDRGWGNGCGLFGKGSLVTCAKFQCLEPIEGKMVQYENLKYTVIITVHTGDQHQVGNETQGVTAEITPQASITEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTTIFAGHLKCRLKMDKLELKGMSYAMCTNTFVLKKEVSETQHGTILIKVEYKGEDAPCKIPFSTEDGQGKAHNGRLITANPVVTKKEEPVNIEAEPPFGESNIVIGIGDNALKINWYKKGSSIGKMFEATARGARRMAILGDTAWDFGSVGGVLNSLGKMVHQVFGSAYTALFSGVSWVMKIGIGVLLTWIGLNSKNTSMSFSCIAIGIITLYLGAVVQADTGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSASRAWNVWEVEDYGFGVFTTNIWLKLREVYTQLCDHRLMSAAVKDERAVHADMGYWIESQKNGSWKLEKASLIEVKTCTWPKSHTLWSNGVLESDMIIPKSLAGPISQHNYRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGKVDNFTMGVLCLAILFEEVMRGKFGKKHMIVGVFFTFVLLLSGQITWRDMAHTLIMIGSNASDRMGMGVTYLALIATFKIQPFLALGFFLRKLTSRENLLLGVGLAMATTLQLPADIEQMANGIALGLMALKLITQFETYQLWTALISLTCSNTIFTLTVAWRTATLILAGVSLLPVCQSSSMRKTDWLPMTVAAMGVQPLPLFIFSLKDTLKRRSWPLNEGVMAVGLVSILASSLLRNDVPMAGPLVAGGLLIACYVITGTSADLTVEKAADVTWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTYNGKRLEPNWASVKKDLISYGGGWRLSAQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKDFAAGRKSIALDLVTEIGRVPSHLAHRTRNALDNLVMLHTSEHGGRAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAAIIAANEMGLLETTKKDLGMSKEPGVVSSTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMTGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVASVNMVSRLLLNRFTMTHRRPTIERDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRSMPGTRKVMGITAEWLWRTLGRNKKPRLCTREEFTKKVRTNAAMGAVFTEENQWDSAKAAVEDEDFWKLVDRERELHKLGKCGSCVYNMMGKREKKLGEFGKAKGSRAIWYMWLGARYLEFEALGFLNEDHWFSRENSYSGVEGEGLHKLGYILRDISTIPGGAMYADDTAGWDTRITEDDLHNEEKITQQMDPEHRQLANAIFKLTYQNKVVKVQRPTPTGTVMDIISRKDQRGSGQVGTYGLNTFTNMEAQLIRQMEGEGVLSKADLENPHLPEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLRETACLGKAYAQMWSLMYFHRRDLRLASNAICSAVPVHWVPTSRTTWSIHAHHQWMTTEDMLTVWNRVWIEDNPWMEDKTPVTTWENVPYLGKREDQWCGSLIGLTSRATWAQNIPTAIQQVRSLIGNEEFLDYMPSMKRFRKEEESEGAIW

SEQ ID NO: 4723 - protein, 3290 aa, Artificial Sequence
  derived and/or modified protein sequence (wt) from DENV-3__FJ898442__SS-prME
TSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAVLPEEQDQNYVCKHTYVDRGWGNGCGLFGKGSLVTCAKFQCLEPIEGKMVQYENLKYTVIITVHTGDQHQVGNETQGVTAEITPQASITEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTTIFAGHLKCRLKMDKLELKGMSYAMCTNTFVLKKEVSETQHGTILIKVEYKGEDAPCKIPFSTEDGQGKAHNGRLITANPVVTKKEEPVNIEAEPPFGESNIVIGIGDNALKINWYKKGSSIGKMFEATARGARRMAILGDTAWDFGSVGGVLNSLGKMVHQVFGSAYTALFSGVSWVMKIGIGVLLTWIGLNSKNTSMSFSCIAIGIITLYLGAVVQADTGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSASRAWNVWEVEDYGFGVFTTNIWLKLREVYTQLCDHRLMSAAVKDERAVHADMGYWIESQKNGSWKLEKASLIEVKTCTWPKSHTLWSNGVLESDMIIPRSLAGPISQHNYRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGKVDNFTMGVLCLAILFEEVMRGKFGKKHMIAGVFFTFVLLLSGQITWRDMAHTLIMIGSNASDRMGMGVTYLALIATFKIQPFLALGFFLRKLTSRENLLLGVGLAMATTLQLPADIEQMANGIALGLMALKLITQFETYQLWTALISLTCSNTIFTLTVAWRTATLILAGVSLLPVCQSSSMRKTDWLPMTVAAMGVQPLPLFIFSLKDTLKRRSWPLNEGVMAVGLVSILASSLLRNDVPMAGPLVAGGLLIACYVITGTSADLTVEKAADVTWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTYNGKRLEPNWASVKKDLISYGGGWRLSAQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKDFAAGRKSIALDLVTEIGRVPSHLAHRTRNALDNLVMLHTSEHGGRAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAAIIAANEMGLLETTKKDLGMSKEPGVVSSTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMTGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVASVNMVSRLLLNRFTMTHRRPTIERDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRSMPGTRKVMGITAEWLWRTLGRNKKPRLCTREEFTKKVRTNAAMGAVFTEENQWDSAKAAVEDEEFWKLVDRERELHKLGKCGSCVYNMMGKREKKLGEFGKAKGSRAIWYMWLGARYLEFEALGFLNEDHWFSRENSYSGVEGEGLHKLGYILRDISTIPGGAMYADDTAGWDTRITEDDLHNEEKITQQMDPEHRQLANAIFKLTYQNKVVKVQRPTPTGTVMDIISRKDQRGSGQVGTYGLNTFTNMEAQLIRQMEGEGVLSKADLENPHLPEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLRETACLGKAYAQMWSLMYFHRRDLRLASNAICSAVPVHWVPTSRTTWSIHAHHQWMTTENMLTVWNRVWIEDNPWMEDKTPVTTWENVPYLGKREDQWCGSLIGLTSRATWAQNIPTAIQQVRSLIGNEEFLDYMPSMKRFRKEEESEGAIW

SEQ ID NO: 4724 - protein, 3290 aa, Artificial Sequence
  derived and/or modified protein sequence (wt) from DENV-3__FJ882575__SS-prME
TSLCLMMILPATLAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAVLPEEQDQNYVCKHTYVDRGWGNGCGLFGKGSLVTCAKFQCLEPIEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDAPCKIPFSTEDGQGKAHNGRLITANPVVTKKEEPVNIEAEPPFGESNIVIGIGDNALKINWYKKGSSIGKMFEATARGARRMAILGDTAWDFGSVGGILNSLGKMVHQIFGSAYTALFSGVSWVMKIGIGVLLTWIGLNSKNTSMSFSCIAIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDTIGVLEQGKRTLTPQPMELKYSWKTWGKAKIVTAETQNSSFIIDGPNTPECPSASRAWNVWEVEDYGFGVFTTNIWLKLREVYTQLCDHRLMSAAVKDERAVHADMGYWIESQKNGSWKLEKASLIEVKTCTWPKSHTLWSNGVLESDMIIPKSLAGPISQHNYRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGKVDNFTMGVLCLAILFEEVMRGKFGKKHMIAGVFFTFVLLLSGQITWRDMAHTLIMIGSNASDRMGMGVTYLALIATFKIQPFLALGFFLRKLTSRENLLLGVGLAMATTLQLPEDIEQMANGIALGLMALKLITQFETYQLWTALISLTCSNTIFTLTVAWRTATLILAGVSLLPVCQSSSMRKTDWLPMTVAAMGVPPLPLFIFSLKDTLKRRSWPLNEGVMAVGLVSILASSLLRNDVPMAGPLVAGGLLIACYVITGTSADLTVEKAADVTWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGILGKTQVGVGVQKEGVFHTMWHVTRGAVLTHNGKRLEPNWASVKKDLISYGGGWRLSAQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKDFAAGRKSIALDLVTEIGRVPSHLAHRTRNALDNLVMLHTSEHGGRAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVSSVNMVSRLLLNRFTMTHRRPTIEKDVDLGAGTRHVDAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRPMPGTRKVMGITAEWLWRTLGRNKRPRLCTREEFTKKVRTNAAMGAVFTEENQWDSAKAAVEDEEFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPTGTVMDIISRKDQRGSGQVGTYGLNTFTNMEAQLVRQMEGEGVLSKADLENPHLPEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLRETACLGKAYAQMWSLMYFHRRDLRLASNAICSAVPVHWVPTSRTTWSIHAHHQWMTTEDMLTVWNRVWIEDNPWMEDKTPVTTWENVPYLGKREDQWCGSLIGLTSRATWAQNIPTAIQQVRSLIGNEEFLDYMPSMKRFRKEEESEGAIW

SEQ ID NO: 4725 - protein, 3290 aa, Artificial Sequence
  derived and/or modified protein sequence (wt) from DENV-3__GQ199886__SS-prME
TSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAVLPEEQDQNYVCKHTYVDRGWGNGCGLFGKGSLVTCAKFQCLEPIEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDVPCKIPFSTEDGQGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWMGLNSKNTSMSFSCIAIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDTIGVLEQGKRTLTPQPMELKYSWKTWGKAKIVTAETQNSSFIIDGPNTPECPSASRAWNVWEVEDYGFGVFTTNIWLKLREVYTQLCDHRLMSAAVKDERAVHADMGYWIESQKNGSWKLEKASLIEVKTCTWPKSHTLWSNGVLESDMIIPKSLAGPISQHNYRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGKVDNFTMGVLCLAILFEEVMRGKFGKKHMIAGVFFTFVLLLSGQITWRDMAHTLIMIGSNASDRMGMGVTYLALIATFKIQPFLALGFFLRKLTSRENLLLGVGLAMATTLQLPEDIEQMANGIALGLMALKLITQFETYQLWTALISLTCSNTIFTLTVAWRTATLILAGVSLLPVCQSSSMRKTDWLPMTVAAMGVPPLPLFIFSLKDTLKRRSWPLNEGVMAVGLVSILASSLLRNDVPMAGPLVAGGLLIACYVITGTSADLTVEKAADVTWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTYNGKRLEPNWASVKKDLISYGGGWRLSAQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEEKDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKDFAAGRKSIALDLVTEIGRVPSHLAHRTRNALDNLVMLHTSEHGGRAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVASVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRSMPGTRRVMGITAEWLWRTLGRNKKPRLCTREEFTKKVRTNAAMGAVFTEENQWDSAKAAVEDEDFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPTGTVMDIISRKDQRGSGQVGTYGLNTFTNMEAQLIRQMEGEGVLSKADLENPHLPEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLRETACLGKAYAQMWSLMYFHRRDLRLASNAICSAVPVHWVPTSRTTWSIHAHHQWMTTEDMLTVWNRVWIEDNPWMEDKTPVTTWENVPYLGKREDQWCGSLIGLTSRATWAQNIPTAIQQVRSLIGNEEFLDYMPSMKRFRKEEESEGAIW

SEQ ID NO: 4726 - protein, 3290 aa, Artificial Sequence
  derived and/or modified protein sequence (wt) from DENV-3__FJ882576__SS-prME
TSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMAMRCVGVGNRDFVEGLSGATWVDVVLEHGGCVTTMAKNKPTLDIELQKTEATQLATLRKLCIEGKITNITTDSRCPTQGEAVLPEEQDQNYVCKHTYVDRGWGNGCGLFGKGSLVTCAKFQCLEPIEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDVPCKIPFSTEDGQGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSASRAWNVWEVEDYGFGVFTTNIWLKLREVYTQLCDHRLMSAAVKDERAVHADMGYWIESQKNGSWKLEKASLIEVKTCTWPKSHTLWSNGVLESDMIIPKSLAGPISQHNYRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGKVDNFTMGVLCLAILFEEVMRGKFGKKHMIAGVFFTFVLLLSGQITWRDMAHTLIMIGSNASDRMGMGVTYLALIATFKIQPFLALGFFLRKLTSRENLLLGVGLAMATTLQLPEDIEQMANGIALGLMALKLITQFETYQLWTALISLTCSNTIFTLTVAWRTATLILAGVSLLPVCQSSSMRKTDWLPMTVAAMGVPPLPLFIFSLKDTLKRRSWPLNEGVMAVGLVSILASSLLRNDVPMAGPLVAGGLLIACYVITGTSADLTVEKAADVTWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLAYNGKRLEPNWASVKKDLISYGGGWRLSAQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGERNNQILEENMDVEIWTKEGEKKKLRPRWLDARTYSDPLALKEFKDFAAGRKSIALDLVTEIGRVPSHLAHRTRNALDNLVMLHTSEHGGRAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVSSVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRSMPGTRRVMGITAEWLWRTLGRNKKPRLCTREEFTKKVRTNAAMGAVFTEENQWDSAKAAVEDEDFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPTGTVMDIISRKDQRGSGQVGTYGLNTFTNMEAQLIRQMEGEGVLSKADLENPHLPEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLRETACLGKAYAQMWSLMYFHRRDLRLASNAICSAVPVHWVPTSRTTWSIHAHHQWMTTEDMLTVWNRVWIEDNPWMEDKTPVTTWENVPYLGKREDQWCGSLIGLTSRATWAQNIPTAIQQVRSLIGNEEFLDYMPSMKRFRKEEESEGAIW

SEQ ID NO: 4727 - protein, 3290 aa, Artificial Sequence
  derived and/or modified protein sequence (wt) from DENV-3__FJ850052__SS-prME
TSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEATLPEEQDQNYVCKHTYVDRGWGNGCGLFGKGSLVTCAKFQCLEPIEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDVPCKIPFSTEDGQGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSVSRAWNVWEVEDYGFGVFTTNIWLKLREVYTQLCDHRLMSAAVKDERAVHADMGYWIESQKNGSWKLEKASLIEVKTCTWPKSHTLWSNGVLESDMIIPKSLAGPISQHNHRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGKVDNFTMGVLCLAILFEEVMRGKFGKKHMIAGVFFTFVLLLSGQITWRDMAHTLIMIGSNASDRMGMGVTYLALIATFKIQPFLALGFFLRKLTSRENLLLGVGLAMATTLQLPEDIEQMANGIALGLMALKLITQFETYQLWTALISLTCSNTIFTLTVAWRTATLILAGVSLLPVCQSSSMRKTDWLPMAVAAMGVPPLPLFIFGLKDTLKRRSWPLNEGVMAVGLVSILASSLLRNDVPMAGPLVAGGLLIACYVITGTSADLTVEKAADITWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTYNGKRLEPNWASVKKDLISYGGGWRLSAQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDKERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKEFAAGRKSIALDLVTEIGRVPSHLAHRTRNALDNLVMLHTSEHGGRAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKDFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVASVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRSMPGTRRVMGITAEWLWRTLGRNKKPRLCTREEFTKKVRTNAAMGAVFTEENQWDSAKAAVEDEDFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPTGTVMDIISRKDQRGSGQVGTYGLNTFTNMEAQLIRQMEGEGVLSKADLENPHLPEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLKETACLGKAYAQMWSLMYFHRRDLRLASNAICSAVPVHWVPTSRTTWSIHAHHQWMTTEDMLTVWNRVWIEDNPWMEDKTPVTTWENVPYLGKREDQWCGSLIGLTSRATWAQNIPTAIQQVRSLIGNEEFLDYMPSMKRFRKEEESEGAIW

SEQ ID NO: 4728 - protein, 3290 aa, Artificial Sequence
  derived and/or modified protein sequence (wt) from DENV-3__FJ873812__SS-prME
TSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEATLPEEQDQNYVCKHTYVDRGWGNGCGLFGKGSLVTCAKFQCLEPIEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDVPCKIPFSTEDGQGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQADMGCVINWKGKELKCGSGIFVTNEVHTWTEQYKFQADSPKRLATAIAGAWENGVCGIRSTTRMENLLWKQISNELNYILWENNIKLTVVVGDIIGVLEQGKRTLTPQPMELKYSWKTWGKAKIVTAETQNSSFIIDGPNTPECPSVSRAWNVWEVEDYGFGVFTTNIWLKLREVYTQLCDHRLMSAAVKDERAVHADMGYWIESQKNGSWKLEKASLIEVKTCTWPKSHTLWSNGVLESDMIIPKSLAGPISQHNHRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGKVDNFTMGVLCLAILFEEVMRGKFGKKHMIAGVFLTFVLLLSGQITWRDMAHTLIMIGSNASDRMGMGVTYLALIATFKIQPFLALGFFLRKLTSRENLLLGVGLAMATTLQLPEDIEQMANGIALGLMALKLITQFETYQLWTALISLTCSNTIFTLTVAWRTATLILAGVSLLPVCQSSSMRKTDWLPMAVAAMGVPPLPLFIFSLKDTLKRRSWPLNEGVMAVGLVSILASSLLRNDVPMAGPLVAGGLLIACYVITGTSADLTVEKAADITWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTYNGKRLEPNWASVKKDLISYGGGWRLSAQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKEFAAGRKSIALDLVTEIGRVPSHLAHRTRNALDNLVMLHTSEHGGRAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKDFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVASVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRSMPGTRRVMGITAEWLWRTLGRNKKPRLCTREEFTKKVRTNAAMGAVFTEENQWDSAKAAVEDEDFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPTGTVMDIISRKDQRGSGQVGTYGLNTFTNMEAQLIRQMEGEGVLSKADLENPHLPEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLKETACLGKAYAQMWSLMYFHRRDLRLASNAICSAVPVHWVPTSRTTWSIHAHHQWMTTEDMLTVWNRVWIEDNPWMEDKTPVTTWENVPYLGKREDQWCGSLIGLTSRATWAQNIPTAIQQVRSLIGNEEFLDYMPSMKRFRKEEESEGAIW

SEQ ID NO: 4729 - protein, 3290 aa, Artificial Sequence
  derived and/or modified protein sequence (wt) from DENV-3__FJ873813__SS-prME
TSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEATLPEEQDQNYVCKHTYVDRGWGNGCGLFGKGSLVTCAKFQCLEPIEGKVVQHENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDVPCKIPFSTEDGQGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSVSRAWNVWEVEDYGFGVFTTNIWLKLREVYTQLCDHRLMSAAVKDERAVHADMGYWIESQKNGSWKLEKASLIEVKTCTWPKSHTLWSNGVLESDMIIPKSLAGPISQHNHRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGKVDNFTMGVLCLAILFEEVMRGKFGKKHMIAGVFFTFVLLLSGQITWRDMAHTLIMIGSNASDRMGMGVTYLALIATFKIQPFLALGFFLRKLTSRENLLLGVGLAMATTLQLPEDIEQMANGIALGLMALKLITQFETYQLWTALISLTCSNTIFTLTVAWRTATLILAGVSLLPVCQSSSMRKTDWLPMAVAAMGVPPLPLFIFSLKDTLKRRSWPLNEGVMAVGLVSILASSLLRNDVPMAGPLVAGGLLIACYVITGTSADLTVEKAADITWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTYNGKRLEPNWASVKKDLISYGGGWRLSAQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKEFAAGRKSIALDLVTEIGRVPSHLAHRTRNALDNLVMLHTSEHGGRAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKDFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRYPLSRNSTHEMYWISNGTGNIVASVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRSMPGTRRVMGITAEWLWRTLGRNKKPRLCTREEFTKKVRTNAAMGAVFTEENQWDSAKAAVEDEDFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPTGTVMDIISRKDQRGSGQVGTYGLNTFTNMEAQLIRQMEGEGVLSKADLENPHLPEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLKETACLGKAYAQMWSLMYFHRRDLRLASNAICSAVPVHWVPTSRTTWSIHAHHQWMTTEDMLTVWNRVWIEDNPWMEDKTPVTTWENVPYLGKREDQWCGSLIGLTSRATWAQNIPTAIQQVRSLIGNEEFLDYMPSMKRFRKEEESEGAIW

SEQ ID NO: 4730 - protein, 3290 aa, Artificial Sequence
  derived and/or modified protein sequence (wt) from DENV-3__FJ850048__SS-prME
TSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEATLPEEQDQNYVCKHTYVDRGWGNGCGLFGKGSLVTCAKFQCLEPIEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDVPCKIPFSTEDGQGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSVSRAWNVWEVEDYGFGVFTTNIWLKLREVYTQLCDHRLMSAAVKDERAVHADMGYWIESQKNGSWKLEKASLIEVKTCTWPKSHTLWSNGVLESDMIIPKSLAGPISQHNHRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGKVDNFTMGVLCLAILFEEVMRGKFGKKHMIAGVFFTFVLLLSGQITWRDMAHTLIMIGSNASDRMGMGVTYLALIATFKIQPFLALGFFLRKLTSRENLLLGVGLAMATTLQLPEDIEQMANGIALGLMALKLITQFETYQLWTALISLTCSNTIFTLTVAWRTATLILAGVSLLPVCQSSSMRKTDWLPMAVAAMGVPPLPLFIFSLKDTLKRRSWPLNEGVMAVGLVSILASSLLRNDVPMAGPLVAGGLLIACYVITGTSADLTVEKAADITWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTYNGKRLEPNWASVKKDLISYGGGWRLSAQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKEFAAGRKSIALDLVTEIGRVPSHLAHRTRNALDNLVMLHTSEHGGRAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKDFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVASVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRSMPGTRRVMGITAEWLWRTLGRNKKPRLCTREEFTKKVRTNAAMGAVFTEENQWDSAKAAVEDEDFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPTGTVMDIISRKDQRGSGQVGTYGLNTFTNMEAQLIRQMEGEGVLSKADLENPHLPEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLKETACLGKAYAQMWSLMYFHRRDLRLASNAICSAVPVHWVPTSRTTWSIHAHHQWMTTEDMLTVWNRVWIEDNPWMEDKTPVTTWENVPYLGKREDQWCGSLIGLTSRATWAQNIPTAIQQVRSLIGNEEFLDYMPSMKRFRKEEESEGAIW

SEQ ID NO: 4731 - protein, 3290 aa, Artificial Sequence
  derived and/or modified protein sequence (wt) from DENV-3__FJ850049__SS-prME
TSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEATLPEEQDQNYVCKHTYVDRGWGNGCGLFGKGSLVTCAKFQCLEPIEGKVVQHENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDVPCKIPFSTEDGQGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSVSRAWNVWEVEDYGFGVFTTNIWLKLREVYTQLCDHRLMSAAVKDERAVHADMGYWIESQKNGSWKLEKASLIEVKTCTWPKSHTLWSNGVLESDMIIPKSLAGPISQHNHRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGKVDNFTMGVLCLAILFEEVMRGKFGKKHMIAGVFFTFVLLLSGQITWRDMAHTLIMIGSNASDRMGMGVTYLALIATFKIQPFLALGFFLRKLTSRENLLLGVGLAMATTLQLPEDIEQMANGIALGLMALKLITQFETYQLWTALISLTCSNTIFTLTVAWRTATLILAGVSLLPMCQSSSMRKTDWLPMAVAAMGVPPLPLFIFSLKDTLKRRSWPLNEGVMAVGLVSILASSLLRNDVPMAGPLVAGGLLIACYVITGTSADLTVEKAANITWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTYNGKRLEPNWASVKKDLISYGGGWRLSAQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKEFAAGRKSIALDLVTEIGRVPSHLAHRTRNALDNLVMLHTSEHGGRAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKDFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVASVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRSMPGTRRVMGITAEWLWRTLGRNKKPRLCTREEFTKKVRTNAAMGAVFTEENQWDSAKAAVEDEDFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPTGTVMDIISRKDQRGSGQVGTYGLNTFTNMEAQLIRQMEGEGVLSKADLENPHLPEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLKETACLGKAYAQMWSLMYFHRRDLRLASNAICSAVPVHWVPTSRTTWSIHAHHQWMTTEDMLTVWNRVWIEDNPWMEDKTPVTTWENVPYLGKREDQWCGSLIGLTSRATWAQNIPTAIQQVRSLIGNEEFLDYMPSMKRFRKEEESEGAIW

SEQ ID NO: 4732 - protein, 3290 aa, Artificial Sequence
  derived and/or modified protein sequence (wt) from DENV-3__FJ898476__SS-prME
TSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEATLPEEQDQNYVCKHTYVDRGWGNGCGLFGKGSLVTCAKFQCLEPIEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDVPCKIPFSTEDGQGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSVSRAWNVWEVEDYGFGVFTTNIWLKLREVYTQLCDHRLMSAAVKDERAVHADMGYWIESQKNGSWKLEKASLIEVKTCTWPKSHTLWSNGVLESDMIIPKSLAGPISQHNHRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGKVDNFTMGVLCLAILFEEVMRGKFGKKHMIAGVFFTFVLLLSGQITWRDMAHTLIMIGSNASDRMGMGVTYLALIATFKIQPFLALGFFLRKLTSRENLLLGVGLAMATTLQLPEDIEQMANGIALGLMALKLITQFETYQLWTALISLTCSNTIFTLTVAWRTATLILAGVSLLPVCQSSSMRKTDWLPMAVAAMGVPPLPLFIFGLKDTLKRRSWPLNEGVMAVGLVSILASSLLRNDVPMAGPLVAGGLLIACYVITGTSADLTVEKAADITWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTYNGKRLEPNWASVKKDLISYGGGWRLSAQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKEFAAGRKSIALDLVTEIGRVPSHLAHRTRNALDNLVMLHTSEHGGRAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKDFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVASVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRSMPGTRRVMGITAEWLWRTLGRNKKPRLCTREEFTKKVRTNAAMGAVFTEENQWDSAKAAVEDEDFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPTGTVMDIISRKDQRGSGQVGTYGLNTFTNMEAQLIRQMEGEGVLSKADLENPHLPEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLKETACLGKAYAQMWSLMYFHRRDLRLASNAICSAVPVHWVPTSRTTWSIHAHHQWMTTEDMLTVWNRVWIEDNPWMEDKTPVTTWENVPYLGKREDQWCGSLIGLTSRATWAQNIPTAIQQVRSLIGNEEFLDYMPSMKRFRKEEESEGAIW

SEQ ID NO: 4733 - protein, 3290 aa, Artificial Sequence
  derived and/or modified protein sequence (wt) from DENV-3__FJ898475__SS-prME
TSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEATLPEEQDQNYVCKHTYVDRGWGNGCGLFGKGSLVTCAKFQCLEPIEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDVPCKIPFSTEDGQGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSVSRAWNVWEVEDYGFGVFTTNIWLKLREVYTQLCDHRLMSAAVKDERAVHADMGYWIESQKNGSWKLEKASLIEVKTCTWPKSHTLWSNGVLESDMIIPKSLAGPISQHNHRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGKVDNFTMGVLCLAILFEEVMRGKFGKKHMIAGVFLTFVLLLSGQITWRDMAHTLIMIGSNASDRMGMGVTYLALIATFKIQPFLALGFFLRKLTSRENLLLGVGLAMATTLQLPEDIEQMANGIALGLMALKLITQFETYQLWTALISLTCSNTIFTLTVAWRTATLILAGVSLLPVCQSSSMRKTDWLPMAVAAMGVPPLPLFIFSLKDTLKRRSWPLNEGVMAVGLVSILASSLLRNDVPMAGPLVAGGLLIACYVITGTSADLTVEKAADITWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTYNGKRLEPNWASVKKDLISYGGGWRLSAQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKEFAAGRKSIALDLVTEIGRVPSHLAHRTRNALDNLVMLHTSEHGGRAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKDFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVASVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRSMPGTRRVMGITAEWLWRTLGRNKKPRLCTREEFTKKVRTNAAMGAVFTEENQWDSAKAAVEDEDFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPTGTVMDIISRKDQRGSGQVGTYGLNTFTNMEAQLIRQMEGEGVLSKADLENPHLPEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLKETACLGKAYAQMWSLMYFHRRDLRLASNAICSAVPVHWVPTSRTTWSIHAHHQWMTTEDMLTVWNRVWIEDNPWMEDKTPVTTWENVPYLGKREDQWCGSLIGLTSRATWAQNIPTAIQQVRSLIGNEEFLDYMPSMKRFRKEEESEGAIW

SEQ ID NO: 4734 - protein, 3290 aa, Artificial Sequence
  derived and/or modified protein sequence (wt) from DENV-3__GQ199861__SS-prME
TSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEATLPEEQDQNYVCKHTYVDRGWGNGCGLFGKGSLVTCAKFQCLEPIEGKVVQHENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDVPCKIPFSTEDGQGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSVSRAWNVWEVEDYGFGVFTTNIWLKLREVYTQLCDHRLMSAAVKDERAVHADMGYWIESQKNGSWKLEKASLIEVKTCTWPKSHTLWSNGVLESDMIIPKSLAGPISQHNHRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGKVDNFTMGVLCLAILFEEVMRGKFGKKHMIAGVFFTFVLLLSGQITWRDMAHTLIMIGSNASDRMGMGVTYLALIATFKIQPFLALGFFLRKLTSRENLLLGVGLAMATTLQLPEDIEQMANGIALGLMALKLITQFETYQLWTALISLTCSNTIFTLTVAWRTATLILAGVSLLPMCQSSSMRKTDWLPMAVAAMGVPPLPLFIFSLKDTLKRRSWPLNEGVMAVGLVSILASSLLRNDVPMAGPLVAGGLLIACYVITGTSADLTVEKAADITWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTYNGKRLEPNWANVKKDLISYGGGWRLSAQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKEFAAGRKSIALDLVTEIGRVPSHLAHRTRNALDNLVMLHTSEHGGRAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKDFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVASVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRSMPGTRRVMGITAEWLWRTLGRNKKPRLCTREEFTKKVRTNAAMGAVFTEENQWDSAKAAVEDEDFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPTGTVMDIISRKDQRGSGQVGTYGLNTFTNMEAQLIRQMEGEGVLSKADLENPHLPEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLKETACLGKAYAQMWSLMYFHRRDLRLASNAICSAVPVHWVPTSRTTWSIHAHHQWMTTEDMLTVWNRVWIEDNPWMEDKTPVTTWENVPYLGKREDQWCGSLIGLTSRATWAQNIPTAIQQVRSLIGNEEFLDYMPSMKRFRKEEESEGAIW

SEQ ID NO: 4735 - protein, 3290 aa, Artificial Sequence
  derived and/or modified protein sequence (wt) from DENV-3__GQ199862__SS-prME
TSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEATLPEEQDQNYVCKHTYVDRGWGNGCGLFGKGSLVTCAKFQCLEPIEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDVPCKIPFSTEDGQGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSVSRAWNVWEVEDYGFGVFTTNIWLKLREVYTQLCDHRLMSAAVKDERAVHADMGYWIESQKNGSWKLEKASLIEVKTCTWPKSHTLWSNGVLESDMIIPKSLAGPISQHNHRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGKVDNFTMGVLCLAILFEEVMRGKFGKKHMIAGVFFTFVLLLSGQITWRDMAHTLIMIGSNASDRMGMGVTYLALIATFKIQPFLALGFFLRKLTSRENLLLGVGLAMATTLQLPEDIEQMANGIALGLMALKLITQFETYQLWTALISLTCSNTIFTLTVAWRTATLILAGVSLLPVCQSSSMRKTDWLPMAVAAMGVPPLPLFIFSLKDTLKRRSWPLNEGVMAVGLVSILASSLLRNDVPMAGPLVAGGLLIACYVITGTSADLTVEKAADITWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGILGKTQVGVGVQKEGVFHTMWHVTRGAVLTYNGKRLEPNWASVKKDLISYGGGWRLSAQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKEFAAGRKSIALDLVTEIGRVPSHLAHRTRNALDNLVMLHTSEHGGRAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPVTTLWEGSPGKFWNTTIAVSMANIFRGSYLAGAGLAFSIMKSVGTGKRGTGSQGETLGEKWKKKLNQLSRKDFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVASVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRSMPGTRRVMGITAEWLWRTLGRNKKPRLCTREEFTKKVRTNAAMGAVFTEENQWDSAKAAVEDEDFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPTGTVMDIISRKDQRGSGQVGTYGLNTFTNMEAQLIRQMEGEGVLSKADLENPHLPEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLKETACLGKAYAQMWSLMYFHRRDLRLASNAICSAVPVHWVPTSRTTWSIHAHHQWMTTEDMLTVWNRVWIEDNPWMEDKTPVTTWENVPYLGKREDQWCGSLIGLTSRATWAQNIPTAIQQVRSLIGNEEFLDYMPSMKRFRKEEESEGAIW

SEQ ID NO: 4736 - protein, 3290 aa, Artificial Sequence
  derived and/or modified protein sequence (wt) from DENV-3__GQ199863__SS-prME
TSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEATLPEEQDQNYVCKHTYVDRGWGNGCGLFGKGSLVTCAKFQCLEPIEGKVVQYENLKYTVIITVHTGDQHQVGNETQGVTAEITPQASTTEVILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDVPCKIPFSTEDGQGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSVSRAWNVWEVEDYGFGVFTTNIWLKLREVYTQLCDHRLMSAAVKDERAVHADMGYWIESQKNGSWKLEKASLIEVKTCTWPKSHTLWSNGVLESDMIIPKSLAGPISQHNHRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGKVDNFTMGVLCLAILFEEVMRGKFGKKHMIAGVFFTFVLLLSGQITWRDMAHTLIMIGSNASDRMGMGVTYLALIATFKIQPFLALGFFLRKLTSRENLLLGVGLAMATTLQLPEDIEQMANGIALGLMALKLITQFETYQLWTALISLTCSNTIFTLTVAWRTATLILAGVSLLPVCQSSSMRKTDWLPMAVAAMGVPPLPLFIFSLKDTLKRRSWPLNEGVMAVGLVSILASSLLRNDVPMAGPLVAGGLLIACYVITGTSADLTVEKAADITWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTYNGKRLEPNWASVKKDLISYGGGWRLSAQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARIYSDPLALKEFKEFAAGRKSIALDLVTEIGRVPSHLAHRTRNALDNLVMLHTSEHGGRAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKDFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVASVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRSMPGTRRVMGITAEWLWRTLGRNKKPRLCTREEFTKKVRTNAAMGAVFTEENQWDSAKAAVEDEDFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPTGTVMDIISRKDQRGSGQVGTYGLNTFTNMEAQLIRQMEGEGVLSKADLENPHLPEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLKETACLGKAYAQMWSLMYFHRRDLRLASNAICSAVPVHWVPTSRTTWSIHAHHQWMTTEDMLTVWNRVWIEDNPWMEDKTPVTTWENVPYLGKREDQWCGSLIGLTSRATWAQNIPTAIQQVRSLIGNEEFLDYMPSMKRFRKEEESEGAIW

SEQ ID NO: 4737 - protein, 3290 aa, Artificial Sequence
  derived and/or modified protein sequence (wt) from DENV-3__GQ199864__SS-prME
TSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLNTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEATLPEEQDQNYVCKHTYVDRGWGNGCGLFGKGSLVTCAKFQCLEPIEGKVVQHENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDVPCKIPFSTEDGQGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSVSRAWNVWEVEDYGFGVFTTNIWLKLREVYTQLCDHRLMSAAVKDERAVHADMGYWIESQKNGSWKLEKASLIEVKTCTWPKSHTLWSNGVLESDMIIPKSLAGPISQHNHRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGKVDNFTIGVLCLAILFEEVMRGKFGKKHMIAGVFFTFVLLLSGQITWRDMAHTLIMIGSNASDRMGMGVTYLALIATFKIQPFLALGFFLRKLTSRENLLLGVGLAMATTLQLPEDIEQMANGIALGLMALKLITQFETYQLWTALISLTCSNTIFTLTVAWRTATLILAGVSLLPVCQSSSMRKTDWLPMAVAAMGVPPLPLFIFSLKDTLKRRSWPLNEGVMAVGLVSILASSLLRNDVPMAGPLVAGGLLIACYVITGTSADLTVEKAADITWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTYNGKRLEPNWASVKKDLISYGGGWRLSAQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKEFAAGRKSIALDLVTEIGRVPSHLAHRTRNALDNLVMLHTSEHGGRAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKDFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVASVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRSMPGTRRVMGITAEWLWRTLGRNKKPRLCTREEFTKKVRTNAAMGAVFTEENQWDSAKAAVEDEDFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPTGTVMDIISRKDQRGSGQVGTYGLNTFTNMEAQLIRQMEGEGVLSKADLENPHLPEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLKETACLGKAYAQMWSLMYFHRRDLRLASNAICSAVPVHWVPTSRTTWSIHAHHQWMTTEDMLTVWNRVWIEDNPWMEDKTPVTTWENVPYLGKREDQWCGSLIGLTSRATWAQNIPTAIQQVRSLIGNEEFLDYMPSMKRFRKEEESEGAIW

SEQ ID NO: 4738 - protein, 3290 aa, Artificial Sequence
  derived and/or modified protein sequence (wt) from DENV-3__GQ199865__SS-prME
TSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEATLPEEQDQNYVCKHTYVDRGWGNGCGLFGKGSLVTCAKFQCLEPIEGKVVQHENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDVPCKIPFSTEDGQGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSVSRAWNVWEVEDYGFGVFTTNIWLKLREVYTQLCDHRLMSAAVKDERAVHADMGYWIESQKNGSWKLEKASLIEVKTCTWPKSHTLWSNGVLESDMIIPKSLAGPISQHNHRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGKVDNFTMGVLCLAILFEEVMRGKFGKKHMIAGVFFTFVLLLSGQITWRDMAHTLIMIGSNASDRMGMGVTYLALIATFKIQPFLALGFFLRKLTSRENLLLGVGLAMATTLQLPEDIEQMANGIALGLMALKLITQFETYQLWTALISLTCSNTIFTLTVAWRTATLILAGVSLLPMCQSSSMRKTDWLPMAVAAMGVPPLPLFIFSLKDTLKRRSWPLNEGVMAVGLVSILASSLLRNDVPMAGPLVAGGLLIACYVITGTSADLTVEKAADITWGEEAEQTGVSHMLMITVEDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTYNGKRLEPNWASVKKDLISYGGGWRLSAQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKEFAAGRKSIALDLVTEIGRVPSHLAHRTRNALDNLVMLHTSEHGGRAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKDFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVASVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRSMPGTRRVMGITAEWLWRTLGRNKKPRLCTREEFTKKVRTNAAMGAVFTEENQWDSAKAAVEDEDFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPTGTVMDIISRKDQRGSGQVGTYGLNTFTNMEAQLIRQMEGEGVLSKADLENPHLPEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLKETACLGKAYAQMWSLMYFHRRDLRLASNAICSAVPVHWVPTSRTTWSIHAHHQWMTTEDMLTVWNRVWIEDNPWMEDKTPVTTWENVPYLGKREDQWCGSLIGLTSRATWAQNIPTAIQQVRSLIGNEEFLDYMPSMKRFRKEEESEGAIW

SEQ ID NO: 4739 - protein, 3290 aa, Artificial Sequence
  derived and/or modified protein sequence (wt) from DENV-3__GQ199870__SS-prME
TSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEATLPEEQDQNYVCKHTYVDRGWGNGCGLFGKGSLVTCAKFQCLEPIEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDVPCKIPFSTEDGQGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSVSRAWNVWEVEDYGFGVFTTNIWLKLREVYTQLCDHRLMSAAVKDERAVHADMGYWIESQKNGSWKLEKASLIEVKTCTWPKSHTLWSNGVLESDMIIPKSLAGPISQHNHRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGKVDNFTMGVLCLAILFEEVMRGKFGKKHMIAGVFFTFVLLLSGQITWRDMAHTLIMIGSNASDRMGMGVTYLALIATFKIQPFLALGFFLRKLTSRENLLLGVGLAMATTLQLPEDIEQMANGIALGLMALKLITQFETYQLWTALISLTCSNTIFTLTVAWRTATLILAGVSLLPVCQSSSMRKTDWLPMAVAAMGVPPLPLFIFGLKDTLKRRSWPLNEGVMAVGLVSILASSLLRNDVPMAGPLVAGGLLIACYVITGTSADLTVEKAADITWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTYNGKRLEPNWASVKKDLISYGGGWRLSAQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKEFAAGRKSIALDLVTEIGRVPSHLAHRTRNALDNLVMLHTSEHGGRAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKDFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMSWISNGTGNIVASVNMVSRLLLNRSTMTHRRPTIEKDVDLGAGPRHVNADPEPPNMDVIGERIKRVKEEHNSTWHYDDENPYKTWAYHGSYEVKATGSASSMINGVVKLLTKPWDVVPMVPQMAMTDTTPFGQQRVFKEKVDTRTPRSIPGTRRVMGITAEWLWRTLGRNKKPRLCTREEFTKKVRTNAAMGAVFTEENQWDSAKAAVEDEDFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPTGTVMDIISRKDQRGSGQVGTYGLNTFTNMEAQLIRQMEGEGVLSKADLENPHLPEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLKETACLGKAYAQMWSLMYFHRRDLRLASNAICSAVPVHWVPTSRTTWSIHAHHQWMTTEDMLTVWNRVWIEDNPWMEDKTPVTTWENVPYLGKREDQWCGSLIGLTSRATWAQNIPTAIQQVRSLIGNEEFLDYMPSMKRFRKEEESEGAIW

SEQ ID NO: 4740 - protein, 3290 aa, Artificial Sequence
  derived and/or modified protein sequence (wt) from DENV-3__JF937630__SS-prME
TSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEATLPEEQDQNYVCKHTYVDRGWGNGCGLFGKGSLVTCAKFQCLEPIEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNAFVLKKEVSETQHGTILIKVEYKGEDVPCKIPFSTEDGQGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSVSRAWNVWEVEDYGFGVFTTNIWLKLREVYTQLCDHRLMSAAVKDERAVHADMGYWIESQKNGSWKLEKASLIEVKTCTWPKSHTLWSNGVLESDMIIPKSLAGPISQHNHRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGKVDNFTMGVLCLAILFEEVMRGKFGKKHMIAGVFFTFVLLLSGQITWRDMAHTLIMIGSNASDRMGMGVTYLALIATFKIQPFLALGFFLRKLTSRENLLLGVGLAMATTLQLPEDIEQMANGIALGLMALKLITQFETYQLWTALISLTCSNTIFTLTVAWRTATLILAGVSLLPVCQSSSMRKTDWLPMAVAAMGVPPLPLFIFSLKDTLKRRSWPLNEGVMAVGLVSILASSLLRNDVPMAGPLVAGGLLIACYVITGTSADLTVEKAADITWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTYNGKRLEPNWASVKKDLISYGGGWRLSAQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKEFAAGRKSIALDLVTEIGRVPSHLAHRTRNALDNLVMLHTSEHGGRAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKDFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVASVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRSMPGTRRVMGITAEWLWRTLGRNKKPRLCTREEFTKKVRTNAAMGAVFTEENQWDSAKAAVEDEDFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPTGTVMDIISRKDQRGSGQVGTYGLNTFTNMEAQLIRQMEGEGVLSKADLENPHLPEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLKETACLGKAYAQMWSLMYFHRRDLRLASNAICSAVPVHWVPTSRTTWSIHAHHQWMTTEDMLTVWNRVWIEDNPWMEDKTPVTTWENVPYLGKREDQWCGSLIGLTSRATWAQNIPTAIQQVRSLIGNEEFLDYMPSMKRFRKEEESEGAIW

SEQ ID NO: 4741 - protein, 3290 aa, Artificial Sequence
  derived and/or modified protein sequence (wt) from DENV-3__JN000936__SS-prME
TSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEATLPEEQDQNYVCKHTYVDRGWGNGCGLFGKGSLVTCAKFQCLEPIEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDVPCKIPFSTEDGQGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSVSRAWNVWEVEDYGFGVFTTNIWLKLREVYTQLCDHRLMSAAVKDERAVHADMGYWIESQKNGSWKLEKASLIEVKTCTWPKSHTLWSNGVLESDMIIPKSLAGPISQHNHRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGKVDNFTMGVLCLAILFEEVMRGKFGKKHMIAGVVFTFVLLLSGQITWRDMAHTLIMIGSNASDRMGMGVTYLALIATFKIQPFLALGFFLRKLTSRENLLLGVGLAMATTLQLPEDIEQMANGIALGLMALKLITQFEIYQLWTALISLTCSNTIFTLTVAWRTATLILAGVSLLPMCQSSSMRKTDWLPMAVAAMGVPPLPLFIFSLKDTLKRRSWPLNEGVMAVGLVSILASSLLRNDVPMAGPLVAGGLLIACYVITGTSADLTVEKAADITWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTYNGKRLEPNWASVKKDLISYGGGWRLSAQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKEFAAGRKSIALDLVTEIGRVPSHLAHRTRNALDNLVMLHTSEHGGRAYRHAVEELPETMETLLLLGLMILLTGGAMLFLISGKGIGKTSIGLICVITSSGMLWMAEIPLQWIASAIVLEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKDFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVASVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRSMPGTRRVMGITAEWLWRTLGRNKKPRLCTREEFTKKVRTNAAMGAVFTEENQWDSAKAAVEDEDFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPTGTVMDIISRKDQRGSGQVGTYGLNTFTNMEAQLIRQMEGEGVLSKADLENPHLPEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLKETACLGKAYAQMWSLMYFHRRDLRLASNAICSAVPVHWVPTSRTTWSIHAHHQWMTTDDMLTVWNRVWIEDNPWMEDKTPVTTWENVPYLGKREDQWCGSLIGLTSRATWAQNIPTAIQQVRSLIGNEEFLDYMPSMKRFRKEEESEGAIW

SEQ ID NO: 4742 - protein, 3290 aa, Artificial Sequence
  derived and/or modified protein sequence (wt) from DENV-3__HQ541796__SS-prME
TSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEATLPEEQDQNYVCKHTYVDRGWGNGCGLFGKGSLVTCAKFQCLEPIEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDVPCKIPFSTEDGQGKAHNGRLITANPVVTKKEEPVNIEAEPPFGESNTVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSVSRAWNVWEVEDYGFGVFTTNIWLKLREVYTQLCDHRLMSAAVKDERAVHADMGYWIESQKNGSWKLEKASLIEVKTCTWPKSHTLWSNGVLESDMIIPKSLAGPISQHNHRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGKVDNFTMGVLCLAILFEEVMRGKFGKKHMIAGVFFTFVLLLSGQITWRDMAHTLIMIGSNASDRMGMGVTYLALIATFKIQPFLALGFFLRKLTSRENLLLGVGLAMATTLQLPEDIEQMANGIALGLMALKLITQFETYQLWTALISLTCSNTIFTLTVAWRTATLILAGVSLLPVCQSSSMRKTDWLPMAVAAMGVPPLPLFIFGLKDTLKRRSWPLNEGVMAVGLVSILASSLLRNDVPMAGPLVAGGLLIACYVITGTSADLTVEKAADITWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTYNGKRLEPNWASVKKDLISYGGGWRLSAQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLTVWLAHKVASEGIKYTDRKWCFDGQRNNQILEENMDVEIWTKEGEKKKLRPRWLDARTYSDPLALKEFKEFAAGRKSIALDLVTEIGRVPSHLAHRTRNALDNLVMLHTSEHGGRAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKDFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVASVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRSMPGTRRVMGITAEWLWRTLGRNKKPRLCTREEFTKKVRTNAAMGAVFTEENQWDSAKAAVEDEDFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPTGTVMDIISRKDQRGSGQVGTYGLNTFTNMEAQLIRQMEGEGVLSKADLENPHLPEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLKETACLGKAYAQMWSLMYFHRRDLRLASNAICSAVPVHWVPTSRTTWSIHAHHQWMTTEDMLTVWNRVWIEDNPWMEDKTPVTTWENVPYLGKREDQWCGSLIGLTSRATWAQNIPTAIQQVRSLIGNEEFLDYMPSMKRFRKEEESEGAIW

SEQ ID NO: 4743 - protein, 3290 aa, Artificial Sequence
  derived and/or modified protein sequence (wt) from DENV-3__HQ166034__SS-prME
TSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEATLPEEQDQNYVCKHTYVDRGWGNGCGLFGKGSLVTCAKFQCLEPIEGKVVQHENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDVPCKIPFSTEDGQGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSVSRAWNVWEVEDYGFGVFTTNIWLKLREVYTQLCDHRLMSAAVKDERAVHADMGYWIESQKNGSWKLEKASLIEVKTCTWPKSHTLWSNGVLESDMIIPKSLAGPISQHNHRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGKVDNFTMGVLCLAILFEEVMRGKFGKKHMIAGVFFTFVLLLSGQITWRDMAHTLIMIGSNASDRMGMGVTYLALIATFKIQPFLALGFFLRKLTSRENLLLGVGLAMATTLQLPEDIEQMANGIALGLMALKLITQFEIYQLWTALISLTCSNTIFTLTVAWRTATLILAGVSLLPMCQSSSMRKTDWLPMAVAAMGVPPLPLFIFSLKDTLKRRSWPLNEGVMAVGLVSILASSLLRNDVPMAGPLVAGGLLIACYVITGTSADLTVEKAADITWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTYNGKRLEPNWASVKKDLISYGGGWRLSAQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKEFAAGRKSIALDLVTEIGRVPSHLAHRTRNALDNLVMLHTSEHGGRAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCVVQLLLMRTSWALCEALTLATGPITTLWEGSPGKFWNTTIAVSMANIFRGSYLAGAGLAFSIMKSVGTGKRGTGSQGETLGEKWKKKLNQLSRKDFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVASVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRSMPGTRRVMGITAEWLWRTLGRNKKPRLCTREEFTKKVRTNAAMGAVFTEENQWDSAKAAVEDEDFWKLVDRERELHKLGKCGSCVYNMMGKREKKLGEFGKAKGSRAIWYMWLGARYLEFEALGFLNEDHWFSRENSYSGVEGEGLHKLGYILRDISKIPGAAMYADDTAGWDTRITEDDLHNEEKITQQMDPEHRQLANAIFKLTYQNKVVKVQRPTPTGTVMDIISRKDQRGSGQVGTYGLNTFTNMEAQLIRQMEGEGVLSKADLENPHLPEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLKETACLGKAYAQMWSLMYFHRRDLRLASNAICSAVPVHWVPTSRTTWSIHAHHQWMTTEDMLTVWNRVWIEDNPWMEDKTPVTTWENVPYLGKREDQWCGSLIGLTSRATWAQNIPTAIQQVRSLIGNEEFLDYMPSMKRFRKEEESEGAIW

SEQ ID NO: 4744 - protein, 3290 aa, Artificial Sequence
  derived and/or modified protein sequence (wt) from DENV-3__HM756274__SS-prME
TSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEATLPEEQDQNYVCKHTYVDRGWGNGCGLFGKGSLVTCAKFQCLEPIEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNAFVLKKEVSETQHGTILIKVEYKGEDVPCKIPFSTEDGQGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSVSRAWNVWEVEDYGFGVFTTNIWLKLREVYTQLCDHRLMSAAVKDERAVHADMGYWIESQKNGSWKLEKASLIEVKTCTWPKSHTLWSNGVLESDMIIPKSLAGPISQHNHRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGKVDNFTMGVLCLAILFEEVMRGKFGKKHMIAGVFFTFVLLLSGQITWRDMAHTLIMIGSNASDRMGMGVTYLALIATFKIQPFLALGFFLRKLTSRENLLLGVGLAMATTLQLPEDIEQMANGIALGLMALKLITQFETYQLWTALISLTCSNTIFTLTVAWRTATLILAGVSLLPVCQSSSMRKTDWLPMAVAAMGVPPLPLFIFGLKDTLKRRSWPLNEGVMAVGLVSILASSLLRNDVPMAGPLVAGGLLIACYVITGTSADLTVEKAADITWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTHNGKRLEPNWASVKKDLISYGGGWRLSAQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKEFAAGRKSIALDLVTEIGRVPSHLAHRTRNALDNLVMLHTSEHGGRAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKDFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVASVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRSMPGTRRVMGITAEWLWRTLGRNKKPRLCTREEFTKKVRTNAAMGAVFTEENQWDSAKAAVEDEDFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPTGTVMDIISRKDQRGSGQVGTYGLNTFTNMEAQLIRQMEGEGVLSKADLENPHLPEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLKETACLGKAYAQMWSLMYFHRRDLRLASNAICSAVPVHWVPTSRTTWSIHAHHQWMTTEDMLTVWNRVWIEDNPWMEDKTPVTTWENVPYLGKREDQWCGSLIGLTSRATWAQNIPTAIQQVRSLIGNEEFLDYMPSMKRFRKEEESEGAIW

SEQ ID NO: 4745 - protein, 3290 aa, Artificial Sequence
  derived and/or modified protein sequence (wt) from DENV-3__HM756275__SS-prME
TSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEATLPEEQDQNYVCKHTYVDRGWGNGCGLFGKGSLVTCAKFQCLEPIEGKVVQHENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDVPCKIPFSTEDGQGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSVSRAWNVWEVEDYGFGVFTTNIWLKLREVYTQLCDHRLMSAAVKDERAVHADMGYWIESQKNGSWKLEKASLIEVKTCTWPKSHTLWSNGVLESDMIIPKSLAGPISQHNHRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGKVDNFTMGVLCLAILFEEVMRGKFGKKHMIAGVFFTFVLLLSGQITWRDMAHTLIMIGSNASDRMGMGVTYLALIATFKIQPFLALGFFLRKLTSRENLLLGVGLAMATTLQLPEDIEQMANGIALGLMALKLITQFEIYQLWTALISLTCSNTIFTLTVAWRTATLILAGVSLLPMCQSSSMRKTDWLPMAVAAMGVPPLPLFIFSLKDTLKRRSWPLNEGVMAVGLVSILASSLLRNDVPMAGPLVAGGLLIACYVITGTSADLTVEKAADITWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTYNGKRLEPNWASVKKDLISYGGGWRLSAQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKEFAAGRKSIALDLVTEIGRVPSHLAHRTRNALDNLVMLHTSEHGGRAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCVVQLLLMRTSWALCEALTLATGPITTLWEGSPGKFWNTTIAVSMANIFRGSYLAGAGLAFSIMKSVGTGKRGTGSQGETLGEKWKKKLNQLSRKDFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVASVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRSMPGTRRVMGITAEWLWRTLGRNKKPRLCTREEFTKKVRTNAAMGAVFTEENQWDSAKAAVEDEDFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPTGTVMDIISRKDQRGSGQVGTYGLNTFTNMEAQLIRQMEGEGVLSKADLENPHLPEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLKETACLGKAYAQMWSLMYFHRRDLRLASNAICSAVPVHWVPTSRTTWSIHAHHQWMTTEDMLTVWNRVWIEDNPWMEDKTPVTTWENVPYLGKREDQWCGSLIGLTSRATWAQNIPTAIQQVRSLIGNEEFLDYMPSMKRFRKEEESEGAIW

SEQ ID NO: 4746 - protein, 3290 aa, Artificial Sequence
  derived and/or modified protein sequence (wt) from DENV-3__JF937632__SS-prME
TSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEATLPEEQDQNYVCKHTYVDRGWGNGCGLFGKGSLVTCAKFQCLEPIEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDVPCKIPFSTEDGQGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSVSRAWNVWEVEDYGFGVFTTNIWLKLREVYTQLCDHRLMSAAVKDERAVHADMGYWIESQKNGSWKLEKASLIEVKTCTWPKSHTLWSNGVLESDMIIPKSLAGPISQHNHRPGYHTQTAGPWHLGKLELDFNYCEGTTVVITENCGTRGPSLRTTTVSGKLIHEWCCRSCTLPPLRYIGEDGCWYGMEIRPISEKEENMVKSLVSAGSGKVDNFTMGVLCLAILFEEVMRGKFGKKHMIAGVFFTFVLLLSGQITWRDMAHTLIMIGSNASDRMGMGVTYLALIATFKIQPFLALGFFLRKLTSRENLLLGVGLAMATTLQLPEDIEQMANGIALGLMALKLITQFETYQLWTALISLTCSNTIFTLTVAWRTATLILAGVSLLPVCQSSSMRKTDWLPMAVAAMGVPPLPLFIFSLKDTLKRRSWPLNEGVMAVGLVSILASSLLRNDVPMAGPLVAGGLLIACYVITGTSADLTVERAADITWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTYNGKRLEPNWASVKKDLISYGGGWRLSAQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKEFAAGRKSIALDLVTEIGRVPSHLAHRTRNALDNLVMLHTSEHGGRAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGPQGETLGEKWKKKLNQLSRKDFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVASVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRSMPGTRRVMGITAEWLWRTLGRNKKPRLCTREEFTKKVRTNAAMGAVFTEENQWDSAKAAVEDEDFWKLVDRERELHKLGKCGSCVYNMMGKREKKLGEFGKAKGSRAIWYMWLGARYLEFEALGFLNEDHWFSRENSYSGVEGEGLHRLGYILRDISKIPGGAMYADDTAGWDTRITEDDLHNEEKITQQMDPEHRQLANAIFKLTYQNKVVKVQRPTPTGTVMDIISRKDQRGSGQVGTYGLNTFTNMEAQLIRQMEGEGVLSKADLENPHLPEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLKETACLGKAYAQMWSLMYFHRRDLRLASNAICSAVPVHWVPTSRTTWSIHAHHQWMTTEDMLTVWNRVWIEDNPWMEDKTPVTTWENVPYLGKREDQWCGSLIGLTSRATWAQNIPTAIQQVRSLIGNEEFLDYMPSMKRFRKEEESEGAIW

SEQ ID NO: 4747 - protein, 3290 aa, Artificial Sequence
  derived and/or modified protein sequence (wt) from DENV-3__HM756281__SS-prME
TSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEATLPEEQDQNYVCKHTYVDRGWGNGCGLFGKGSLVTCAKFQCLEPIEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDVPCKIPFSTEDGQGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQADMGCVVNWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPKELKYSWKTWGKAKIVTAETQNSSFIIDGPNTPECPSVSRAWNVWEVEDYGFGVFTTNIWLKLREVYTQLCDHRLMSAAVKDERAVHADMGYWIESQKNGSWKLEKASLIEVKTCTWPKSHTLWSNGVLESDMIIPKSLAGPISQHNHRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGKVDNFTMGVLCLAILFEEVMRGKFGKKHMIAGVFFTFVLLLSGQITWRDMAHTLIMIGSNASDRMGMGVTYLALIATFKIQPFLALGFFLRKLTSRENLLLGVGLAMATTLQLPEDIEQMANGIALGLMALKLITQFETYQLWTALISLTCSNTIFTLTVAWRTATLILAGVSLLPVCQSSSMRKTDWLPMAVAAMGVPPLPLFIFSLKDTLKRRSWPLNEGVMAVGLVSILASSLLRNDVPMAGPLVAGGLLIACYVITGTSADLTVEKAADITWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTYNGKRLEPNWASVKKDLISYGGGWRLSAQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKEFAAGRKSIALDLVTEIGRVPSHLAHRTRNALDNLVMLHTSEHGGRAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKDFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVASVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFREKVDTRTPRSMPGTRRVMGITAEWLWRTLGRNKKPRLCTREEFTKKVRTNAAMGAVFTEENQWDSAKAAVEDEDFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPTGTVMDIISRKDQRGSGQVGTYGLNTFTNMEAQLIRQMEGEGVLSKADLENPHLPEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLKETACLGKAYAQMWSLMYFHRRDLRLASNAICSAVPVHWVPTSRTTWSIHAHHQWMTTEDMLTVWNRVWIEDNPWMEDKTPVTTWENVPYLGKREDQWCGSLIGLTSRATWAQNIPTAIQQVRSLIGNEEFLDYMPSMKRFRKEEESEGAIW

SEQ ID NO: 4748 - protein, 3290 aa, Artificial Sequence
  derived and/or modified protein sequence (wt) from DENV-3__JF937643__SS-prME
TSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEATLPEEQDQNYVCKHTYVDRGWGNGCGLFGKGSLVTCAKFQCLEPIEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDVPCKIPFSTEDGQGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSVSRAWNVWEVEDYGFGVFTTNIWLKLREVYTQLCDHRLMSAAVKDEKAVHADMGYWIESQKNGSWKLEKASLIEVKTCTWPKSHTLWSNGVLESDMIIPKSLAGPISQHNHRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGKVDNFTMGVLCLAILFEEVMRGKFGKKHMIAGVFFTFVLLLSGQITWRDMAHTLIMIGSNASDRMGMGVTYLALIATFKIQPFLALGFFLRKLTSRENLLLGVGLAMATTLQLPEDIEQMANGIALGLMALKLIAQFETYQLWTALISLTCSNTIFTLTVAWRTATLILAGVSLLPVCQSSSMRKTDWLPMAVAAMGVPPLPLFIFSLKDTLKRRSWPLNEGVMAVGLVSILASSLLRNDVPMAGPLVAGGLLIACYVITGTSADLTVEKAADITWEEEAEQTGVSHNLMIAVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTYNGKRLEPNWASVKKDLISYGGGWRLSAQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKEFAAGRKSIALDLVTEIGRVPSHLAHRTRNALDNLVMLHTSEHGGRAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAAVIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKDFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVASVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRSMPGTRRVMGITAEWLWRTLGRNKKPRLCTREEFTKKVRTNAAMGAVFTEENQWDSAKAAVEDEDFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPTGTVMDIISRKDQRGSGQVGTYGLNTFTNMEAQLIRQMEGEGVLSKADLENPHLPEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLKETACLGKAYAQMWSLMYFHRRDLRLASNAICSAVPVHWVPTSRTTWSIHAHHQWMTTDDMLTVWNRVWIEDNPWMEDKTPVTTWENVPYLGKREDQWCGSLIGLTSRATWAQNIPTAIQQVRSLIGNEEFLDYMPSMKRFRKEEESEGAIW

SEQ ID NO: 4749 - protein, 3290 aa, Artificial Sequence
  derived and/or modified protein sequence (wt) from DENV-3__HM181972__SS-prME
TSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEATLPEEQDQNYVCKHTYVDRGWGNGCGLFGKGSLVTCAKFQCLEPIEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDVPCKIPFSTEDGQGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSVSRAWNVWEVEDYGFGVFTTNIWLKLREVYTQLCDHRLMSAAVKDERAVHADMGYWIESQKNGSWKLEKASLIEVKTCTWPKSHTLWSNGVLESDMIIPKSLAGPISQHNHRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGKVDNFTMGVLCLAILFEEVMRGKFGKKHMIAGVFFTFVLLLSGQITWRDMAHTLIMIGSNASDRMGMGVTYLALIATFKIQPFLVLGFFLRKLTSRENLLLGVGLAMATTLQLPEDIEQMANGIALGLMALKLITQFETYQLWTALISLTCSNTIFTLTVAWRTATLILAGVSLLPVCQSSSMRKTDWLPMAVAAMGVPPLPLFIFSLKDTLKRRSWPLNEGVMAVGLVSILASSLLRNDVPMAGPLVAGGLLIACYVITGTSADLTVEKAADITWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTYNGKRLEPNWASVKKDLISYGGGWRLSAQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKEFAAGRKSIALDLVTEIGRVPSHLAHRTRNALDNLVMLHTSEHGGRAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKDFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVASVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRSMPGTRRVMGITAEWLWRTLGRNKKPRLCTREEFTKKVRTNAAMGAVFTEENQWDSAKAAVEDEDFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPTGTVMDIISRKDQRGSGQVGTYGLNTFTNMEAQLIRQMEGEGVLSKADLENPHLPEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLKETACLGKAYAQMWSLMYFHRRDLRLASNAICSAVPVHWVPTSRTTWSIHAHHQWMTTEDMLTVWNRVWIEDNPWMEDKTPVTTWGNVPYLGKREDQWCGSLIGLTSRATWAQNIPTAIQQVRSLIGNEEFLDYMPSMKRFRKEEESEGAIW

SEQ ID NO: 4750 - protein, 3290 aa, Artificial Sequence
  derived and/or modified protein sequence (wt) from DENV-3__HM631857__SS-prME
TSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEATLPEEQDQNYVCKHTYVDRGWGNGCGLFGKGSLVTCAKFQCLEPIEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDVPCKIPFSTEDGQGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSVSRAWNVWEVEDYGFGVFTTNIWLKLREVYTQLCDHRLMSAAVKDERAVHADMGYWIESQKNGSWKLEKASLIEVKTCTWPKSHTLWSNGVLESDMIIPKSLAGPISQHNHRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGKVDNFTMGVLCLAILFEEVMRGKFGKKHMIAGVFFTFVLLLSGQITWRDTAHTLIMIGSNASDRMGMGVTYLALIATFKIQPFLALGFFLRKLTSRENLLLGVGLAMATTLQLPEDIEQMANGIALGLMALKLITQFETYQLWTALISLTCSNTIFTLTVAWRTATLILAGVSLLPVCQSSSMRKTDWLPMAVAAMGVPPLPLFIFGLKDTLKRRSWPLNEGVMAVGLVSILASSLLRNDVPMAGPLVAGGLLIACYVITGTSADLTVEKAADITWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTYNGKRLEPNWASVKKDLISYGGGWRLSAQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIADLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKEFAAGRKSIALDLVTEIGRVPSHLAHRTRNALDNLVMLHTSEHGGRAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAAVIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKDFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVASVNMVSRLLLNRFTMTHRRPTIEKDVDLGAGTRHVNVEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRSMPGTRRVMGITAEWLWRTLGRNKKPRLCTREEFTKKVRTNAAMGAVFTEENQWDSAKAAVEDEDFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPTGTVMDIISRKDQRGSGQVGTYGLNTFTNMEAQLIRQMEGEGVLSKADLENPHLPEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLKETACLGKAYAQMWSLMYFHRRDLRLASNAICSAVPVHWVPTSRTTWSIHAHHQWMTTEDMLTVWNRVWIEDNPWMEDKTPVTTWENVPYLGKREDQWCGSLIGLTSRATWAQNIPTAIQQVRSLIGNEEFLDYMPSMKRFRKEEESEGAIW

SEQ ID NO: 4751 - protein, 3290 aa, Artificial Sequence
  derived and/or modified protein sequence (wt) from DENV-3__HM631860__SS-prME
TSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEATLPEEQDQNYVCKHTYVDRGWGNGCGLFGKGSLVTCAKFQCLEPIEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDVPCKIPFSTEDGQGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQADMGCVVNWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPKELKYSWKTWGKAKIVTAETQNSSFIIDGPNTPECPSVSRAWNVWEVEDYGFGVFTTNIWLKLREVYTQLCDHRLMSAAVKDERAVHADMGYWIESQKNGSWKLEKASLIEVKTCTWPKSHTLWSNGVLESDMIIPKSLAGPISQHNHRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGKVDNFTMGVLCLAILFEEVMRGKFGKKHMIAGVFFTFVLLLSGQITWRDMAHTLIMIGSNASDRMGMGVTYLALIATFKIQPFLALGFFLRKLTSRENLLLGVGLAMATTLQLPEDIEQMANGIALGLMALKLITQFETYQLWTALISLTCSNTYFTLTVAWRTATLILAGVSLLPVCQSSSMRKTDWLPMAVAAMGVPPLPLFIFSLKDTLKRRSWPLNEGVMAVGLVSILASSLLRNDVPMAGPLVAGGLLIACYVITGTSADLTVEKAADITWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTYNGKRLEPNWASVKKDLISYGGGWRLSAQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKEFAAGRKSIALDLVTEIGRVPSHLAHRTRNALDNLVMLHTSEHGGRAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKDFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVASVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRSMPGTRRVMGITAEWLWRTLGRNKKPRLCTREEFTKKVRTNAAMGAVFTEENQWDSAKAAVEDEDFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPTGTVMDIISRKDQRGSGQVGTYGLNTFTNMEAQLIRQMEGEGVLSKADLENPHLPEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLKETACLGKAYAQMWSLMYFHRRDLRLASNAICSAVPVHWVPTSRTTWSIHAHHQWMTTEDMLTVWNRVWIEDNPWMEDKTPVTTWENVPYLGKREDQWCGSLIGLTSRATWAQNIPTAIQQVRSLIGNEEFLDYMPSMKRFRKEEESEGAIW

SEQ ID NO: 4752 - protein, 3290 aa, Artificial Sequence
  derived and/or modified protein sequence (wt) from DENV-3__HM181977__SS-prME
TSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEATLPEEQDQNYVCKHTYVDRGWGNGCGLFGKGSLVTCAKFQCLEPIEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDVPCKIPFSTEDGQGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQADMGCVVNWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPKELKYSWKTWGKAKIVTAETQNSSFIIDGPNTPECPSVSRAWNVWEVEDYGFGVFTTNIWLKLREVYTQLCDHRLMSAAVKDERAVHADMGYWIESQKNGSWKLEKASLIEVKTCTWPKSHTLWSNGVLESDMIIPKSLAGPISQHNHRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGKVDNFTMGVLCLAILFEEVMRGKFGKKHMIAGVFFTFVLLLSGQITWRDMAHTLIMIGSNASDRMGMGVTYLALIATFKIQPFLALGFFLRKLTSRENLLLGVGLAMATTLQLPEDIEQMANGIALGLMALKLITQFETYQLWTALISLTCSNTIFTLTVAWRTATLILAGVSLLPVCQSSSMRKTDWLPMAVAAMGVPPLPLFIFSLKDTLKRRSWPLNEGVMAVGLVSILASSLLRNDVPMAGPLVAGGLLIACYVITGTSADLTVEKAADITWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTYNGKRLEPNWASVKKDLISYGGGWRLSAQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKEFAAGRKSIALDLVTEIGRVPSHLAHRTRNALDNLVMLHTSEHGGRAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKDFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVASVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRSMPGTRRVMGITAEWLWRTLGRNKKPRLCTREEFTKKVRTNAAMGAVFTEENQWDSAKAAVEDEDFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPTGTVMDIISRKDQRGSGQVGTYGLNTFTNMEAQLIRQMEGEGVLSKADLENPHLPEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLKETACLGKAYAQMWSLMYFHRRDLRLASNAICSAVPVHWVPTSRTTWSIHAHHQWMTTEDMLTVWNRVWIEDNPWMEDKTPVTTWENVPYLGKREDQWCGSLIGLTSRATWAQNIPTAIQQVRSLIGNEEFLDYMPSMKRFRKEEESEGAIW

SEQ ID NO: 4753 - protein, 3290 aa, Artificial Sequence
  derived and/or modified protein sequence (wt) from DENV-3__HM181978__SS-prME
TSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEATLPEEQDQNYVCKHTYVDRGWGNGCGLFGKGSLVTCAKFQCLEPIEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDVPCKIPFSTEDGQGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSVSRAWNVWEVEDYGFGVFTTNIWLKLREVYTQLCDHRLMSAAVKDERAVHADMGYWIESQKNGSWKLEKASLIEVKTCTWPKSHTLWSNGVLESDMIIPKSLAGPISQHNHRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGKVDNFTMGVLCLAILFEEVMRGKFGKKHMIAGVFFTFVLLLSGQITWRDMAHTLIMIGSSASDRMGMGVTYLALIATFKIQPFLALGFFLRKLTSRENLLLGVGLAMATTLQLPEDIEQMANGIALGLMALKLITQFETYQLWTALISLTCSNTIFTLTVAWRTATLILAGVSLLPVCQSSSMRKTDWLPMAVAAMGVPPLPLFIFGLKDTLKRRSWPLNEGVMAVGLVSILASSLLRNDVPMAGPLVAGGLLIACYVITGTSADLTVEKAADITWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTYNGKRLEPNWASVKKDLISYGGGWRLSAQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKEFAAGRKSIALDLVTEIGRVPSHLAHRTRNALDNLVMLHTSEHGGRAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKDFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVASVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRSMPGTRRVMGITAEWLWRTLGRNKKPRLCTREEFTKKVRTNAAMGAVFTEENQWDSAKAAVEDEDFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPTGTVMDIISRKDQRGSGQVGTYGLNTFTNMEAQLIRQMEGEGVLSKADLENPHLPEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLKETACLGKAYAQMWSLMYFHRRDLRLASNAICSAVPVHWVPTSRTTWSIHAHHQWMTTEDMLTVWNRVWIEDNPWMEDKTPVTTWENVPYLGKREDQWCGSLIGLTSRATWAQNIPTAIQQVRSLIGNEEFLDYMPSMKRFRKEEESEGAIW

SEQ ID NO: 4754 - protein, 3290 aa, Artificial Sequence
  derived and/or modified protein sequence (wt) from DENV-3__JN183884__SS-prME
TSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEATLPEEQDQNYVCKHTYVDRGWGNGCGLFGKGSLVTCAKFQCLEPIEGKVVQYENLKYTVIITVHTGDQHQVGNETQGVTAEITPQASTTEAILPEYGTLGLECSPRTGLDFNEMILLKMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDVPCKIPFSTEDGQGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSVSRAWNVWEVEDYGFGVFTTNIWLKLREVYTQLCDHRLMSAAVKDERAVHADMGYWIESQKNGSWKLEKASLIEVKTCTWPKSHTLWSNGVLESDMIIPKSLAGPISQHNHRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGKVDNFTMGVLCLAILFEEVMRGKFGKKHMIAGVFFTFVLLLSGQITWRDMAHTLIMIGSNASDRMGMGVTYLALIATFKIQPFLALGFFLRKLTSRENLLLGVGLAMATTLQLPEDIEQMANGIALGLMALKLITQFETYQLWTALISLTCSNTIFTLTVAWRTATLILAGVSLLPVCQSSSMRKTDWLPMAVAAMGVPPLPLFIFGLKDTLKRRSWPLNEGVMAVGLVSILASSLLRNDVPMAGPLVAGGLLIACYVITGTSADLTVEKAADITWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTYNGKRLEPNWASVKKDLISYGGGWRLSAQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKEFAAGRKSIALDLVTEIGRVPSHLAHRTRNALDNLVMLHTSEHGGRAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKDFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVASVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRSMPGTRRVMGITAEWLWRTLGRNKKPRLCTREEFTKKVRTNAAMGAVFTEENQWDSAKAAVEDEDFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPTGTVMDIISRKDQRGSGQVGTYGLNTFTNMEAQLIRQMEGEGVLSKADLENPHLPEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLKETACLGKAYAQMWSLMYFHRRDLRLASNAICSAVPVHWVPTSRTTWSIHAHHQWMTTEDMLTVWNRVWIEDNPWMEDKTPVTTWENVPYLGKREDQWCGSLIGLTSRATWAQNIPTAIQQVRSLIGNEEFLDYMPSMKRFRKEEESEGAIW

SEQ ID NO: 4755 - protein, 3290 aa, Artificial Sequence
  derived and/or modified protein sequence (wt) from DENV-3__HQ541785__SS-prME
TSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEATLPEEQDQNYVCKHTYVDRGWGNGCGLFGKGSLVTCAKFQCLEPIEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDVPCKIPFSTEDGQGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSVSRAWNVWEVEDYGFGVFTTNIWLKLREVYTQLCDHRLMSAAVKDERAVHADMGYWIESQKNGSWKLEKASLIEVKTCTWPKSHTLWSNGVLESDMIIPKSLAGPISQHNHRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGKVDNFTMGVLCLAILFEEVMRGKFGKKHMIAGVFFTFVLLLSGQITWRDMAHTLIMIGSNASDRMGMGVTYLALIATFKIQPFLALGFFLRKLTSRENLLLGVGLAMATTLQLPEDIEQMANGIALGLMALKLITQFETYQLWTALISLTCSNTIFTLTVAWRTATLILAGVSLLPVCQSSSMRKTDWLPMAVAAMGVPPLPLFIFSLKDTLKRRSWPLNEGVMAVGLVSILASSLLRNDVPMAGPLVAGGLLIACYVITGTSADLTVEKAADITWEEEAEQTGVSHNLMIAVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTYNGKRLEPNWASVKKDLISYGGGWRLSAQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKEFAAGRKSIALDLVTEIGRVPSHLAHRTRNALDNLVMLHTSEHGGRAYRHAVEELPETMETLLLLGLMILLTGGAMLFLISGKGIGKTSIGLICVITSSGMLWMAEIPLQWIASAIVLEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKDFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVASVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRSMPGTRRVMGITAEWLWRTLGRNKKPRLCTREEFTKKVRTNAAMGAVFTEENQWDSAKAAVEDEDFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPTGTVMDIISRKDQRGSGQVGTYGLNTFTNMEAQLIRQMEGEGVLSKADLENPHLPEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLKETACLGKAYAQMWSLMYFHRRDLRLASNAICSAVPVHWVPTSRTTWSIHAHHQWMTTDDMLTVWNRVWIEDNPWMEDKTPVTTWENVPYLGKREDQWCGSLIGLTSRATWAQNIPTAIQQVRSLIGNEEFLDYMPSMKRFRKEEESEGAIW

SEQ ID NO: 4756 - protein, 3290 aa, Artificial Sequence
  derived and/or modified protein sequence (wt) from DENV-3__HM181975__SS-prME
TSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFVLLMLVTPSMTMRCVGVGNRDFVEGLSGATWVDVVLEHGGCVTTMAKNKPTLDIELQKTEATQLATLRKLCIEGKITNITTDSRCPTQGEATLPEEQDQNYVCKHTYVDRGWGNGCGLFGKGSLVTCAKFQCLEPIEGKVVQHENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDVPCKIPFSTEDGQGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSVSRAWNVWEVEDYGFGVFTTNIWLKLREVYTQLCDHRLMSAAVKDERAVHADMGYWIESQKNGSWKLEKASLIEVKTCTWPKSHTLWSNGVLESDMIIPKSLAGPISQHNHRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGKVDNFTMGVLCLAILFEEVMRGKFGKKHMIAGVFFTFVLLLSGQITWRDMAHTLIMIGSNASDRMGMGVTYLALIATFKIQPFLALGFFLRKLTSRENLLLGVGLAMATTLQLPEDIEQMANGIALGLMALKLITQFEIYQLWTALISLTCSNTIFTLTVAWRTATLILAGVSLLPMCQSSSMRKTDWLPMAVAAMGVPPLPLFIFSLKDTLKRRSWPLNEGVMAVGLVSILASSLLRNDVPMAGPLVAGGLLIACYVITGTSADLTVEKAADITWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTYNGKRLEPNWASVKKDLISYGGGWRLSAQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKEFAAGRKSIALDLVTEIGRVPSHLAHRTRNALDNLVMLHTSEHGGRAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCVVQLLLMRTSWALCEALTLATGPITTLWEGSPGKFWNTTIAVSMANIFRGSYLAGAGLAFSIMKSVGTGKRGTGSQGETLGEKWKKKLNQLSRKDFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVASVNMVSRLLLNRFTMIHRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRSMPGTRRVMGITAEWLWRTLGRNKKPRLCTREEFTKKVRTNAAMGAVFTEENQWDSAKAAVEDEDFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPTGTVMDIISRKDQRGSGQVGTYGLNTFTNMEAQLIRQMEGEGVLSKADLENPHLPEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLKETACLGKAYAQMWSLMYFHRRDLRLASNAICSAVPVHWVPTSRTTWSIHAHHQWMTTEDMLTVWNRVWIEDNPWMEDKTPVTTWENVPYLGKREDQWCGSLIGLTSRATWAQNIPTAIQQVRSLIGNEEFLDYMPSMKRFRKEEESEGAIW

SEQ ID NO: 4757 - protein, 3290 aa, Artificial Sequence
  derived and/or modified protein sequence (wt) from DENV-3__HM631864__SS-prME
TSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEATLPEEQDQNYVCKHTYVDRGWGNGCGLFGKGSLVTCAKFQCLEPIEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDVPCKIPFSTEDGQGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSVSRAWNVWEVEDYGFGVFTTNIWLKLREVYTQLCDHRLMSAAVKDEKAVHADMGYWIESQKNGSWKLEKASLIEVKTCTWPKSHTLWSNGVLESDMIIPKSLAGPISQHNHRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGKVDNSTMGVLCLAILFEEVMRGKFGKKHMIAGVFFTFVLLLSGQITWRDMAHTLIMIGSNASDRMGMGVTYLALIATFKIQPFLALGFFLRKLTSRENLLLGVGLAMATTLQLPEDIEQMANGIALGLMALKLITQFETYQLWTALISLTCSNTIFTLTVAWRTATLILAGVSLLPVCQSSSMRKTDWLPMAVAAMGVPPLPLFIFSLKDTLKRRSWPLNEGVMAVGLVSILASSLLRNDVPMAGPLVAGGLLIACYVITGTSADLTVEKAADITWEEEAEQTGVSHNLMIAVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTYNGKRLEPNWASVKKDLISYGGGWRLSAQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKEFAAGRKSIALDLVTEIGRVPSHLAHRTRNALDNLVMLHTSEHGGRAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAAVIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKDFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVASVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRSMPGTRRVMGITAEWLWRTLGRNKKPRLCTREEFTKKVRTNAAMGAVFTEENQWDSAKAAVEDEDFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPTGTVMDIISRKDQRGSGQVGTYGLNTFTNMEAQLIRQMEGEGVLSKADLENPHLPEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLKETACLGKAYAQMWSLMYFHRRDLRLASNAICSAVPVHWVPTSRTTWSIHAHHQWMTTDDMLTVWNRVWIEDNPWMEDKTPVTTWENVPYLGKREDQWCGSLIGLTSRATWAQNIPTAIQQVRSLIGNEEFLDYMPSMKRFRKEEESEGAIW

SEQ ID NO: 4758 - protein, 3290 aa, Artificial Sequence
  derived and/or modified protein sequence (wt) from DENV-3__HM631859__SS-prME
TSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEATLPEEQDQNYVCKHTYVDRGWGNGCGLFGKGSLVTCAKFQCLEPIEGKVVQHENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDVPCKIPFSTEDGQGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSVSRAWNVWEVEDYGFGVFTTNIWLKLREVYTQLCDHRLMSAAVKDERAVHADMGYWIESQKNGSWKLEKASLIEVKTCTWPKSHTLWSNGVLESDMIIPKSLAGPISQHNHRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGKVDNFTMGVLCLAILFEEVMRGKFGKKHMIAGVFFTFVLLLSGQITWRDMAHTLIMIGSNASDRMGMGVTYLALIATFKIQPFLALGFFLRKLTSRENLLLGVGLAMATTLQLPEDIEQMANGIALGLMALKLITQFEIYQLWTALISLTCSNTIFTLTVAWRTATLILAGVSLLPMCQSSSMRKTDWLPMAVAAMGVPPLPLFIFSLKDTLKRRSWPLNEGVMAVGLVSILASSLLRNDVPMAGPLVAGGLLIACYVITGTSADLTVEKAADITWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTYNGKRLEPNWASVKKDLISYGGGWRLSAQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKEFAAGRKSIALDLVTEIGRVPSHLAHRTRNALDNLVMLHTSEHGGRAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCVVQLLLMRTSWALCEALTLATGPITTLWEGSPGKFWNTTIAVSMANIFRGSYLAGAGLAFSIMKSVGTGKRGTGSQGETLGEKWKKKLNQLSRKDFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVASVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRSMPGTRRVMGITAEWLWRTLGRNKKPRLCTREEFTKKVRTNAAMGAVFTEENQWDSAKAAVEDEDFWRLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPTGTVMDIISRKDQRGSGQVGTYGLNTFTNMEAQLIRQMEGEGVLSKADLENPHLPEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLKETACLGKAYAQMWSLMYFHRRDLRLASNAICSAVPVHWVPTSRTTWSIHAHHQWMTTEDMLTVWNRVWIEDNPWMEDKTPVTTWENVPYLGKREDQWCGSLIGLTSRATWAQNIPTAIQQVRSLIGNEEFLDYMPSMKRFRKEEESEGAIW

SEQ ID NO: 4759 - protein, 3289 aa, Artificial Sequence
  derived and/or modified protein sequence (wt) from DENV-3__HM631856__SS-prME
TSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEATLPEEQDQNYVCKHTYVDRGWGNGCGLFGKGSLVTCAKFQCLEPIEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDVPCKIPFSTEDGQGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQADMGCVVNWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPKELKYSWKTWGKAKIVTAETQNSSFIIDGPNTPECPSVSRAWNVWEVEDYGFGVFTTNIWLKLREVYTQLCDHRLMSAAVKDERAVHADMGYWIESQKNGSWKLEKASLIEVKTCTWPKSHTLWSNGVLESDMIIPKSLAGPISQHNHRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGKVDNFTMGVLCLAILFEEVMRGKFGKKHMIAGVFFTFVLLLSGQITWRDMAHTLIMIGSNASDRMGMGVTYLALIATFKIQPFLALGFFLRKLTSRENLLLGVGLAMATTLQLPEDIEQMANGIALGLMALKLITQFETYQLWTALISLTCSNTIFTLTVAWRTATLILAGVSLLPVCQSSSMRKTDWLPMAVAAMGVPPLPLFIFSLKDTLKRRSWPLNEGVMAVGLVSILASSLLRNDVPMAGPLVAGGLLIACYVITGTSADLTVEKAADITWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTYNGKRLEPNWASVKKDLISYGGGWRLSAQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFRKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKEFAAGRKSIALDLVTEIGRVPSHLAHRTRNALDNLVMLHTSEHGGRAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKDFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVASVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRSMPGTRRVMGITAEWLWRTLGRNKPRLCTREEFTKKVRTNAAMGAVFTEENQWDSAKAAVEDEDFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPTGTVMDIISRKDQRGSGQVGTYGLNTFTNMEAQLIRQMEGEGVLSKADLENPHLPEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLKETACLGKAYAQMWSLMYFHRRDLRLASNAICSAVPVHWVPTSRTTWSIHAHHQWMTTEDMLTVWNRVWIEDNPWMEDKTPVTTWENVPYLGKREDQWCGSLIGLTSRATWAQNIPTAIQQVRSLIGNEEFLDYMPSMKRFRKEEESEGAIW

SEQ ID NO: 4760 - protein, 3290 aa, Artificial Sequence
  derived and/or modified protein sequence (wt) from DENV-3__HM756276__SS-prME
TSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEATLPEEQDQNYVCKHTYVDRGWGNGCGLFGKGSLVTCAKFQCLEPIEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDVPCKIPFSTEDGQGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQADMGCVVNWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSVSRAWNVWEVEDYGFGVFTTNIWLKLREVYTQLCDHRLMSAAVKDERAVHADMGYWIESQKNGSWKLEKASLIEVKTCTWPKSHTLWSNGVLESDMIIPKSLAGPISQHNHRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGKVDNFTMGVLCLAILFEEVMRGKFGKKHMIAGVFFTFVLLLSGQITWRDMAHTLIMIGSNASDRMGMGVTYLALIATFKIQPFLALGFFLRKLTSRENLLLGVGLAMATTLQLPEDIEQMANGIALGLMALKLITQFETYQLWTALISLTCSNTIFTLTVAWRTATLILAGVSLLPVCQSSSMRKTDWLPMAVAAMGVPPLPLFIFSLKDTLKRRSWPLNEGVMAVGLVSILASSLLRNDVPMAGPLVAGGLLIACYVITGTSADLTVEKAADITWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTYNGKRLEPNWASVKKDLISYGGGWRLSAQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKEFAAGRKSIALDLVTEIGRVPSHLAHRTRNALDNLVMLHTSEHGGRAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKDFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVASVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRSMPGTRRVMGITAEWLWRTLGRNKKPRLCTREEFTKKVRTNAAMGAVFTEENQWDSAKAAVEDEDFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPTGTVMDIISRKDQRGSGQVGTYGLNTFTNMEAQLIRQMEGEGVLSKADLENPHLPEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLKETACLGKAYAQMWSLMYFHRRDLRLASNAICSAVPVHWVPTSRTTWSIHAHHQWMTTEDMLTVWNRVWIEDNPWMEDKTPVTTWENVPYLGKREDQWCGSLIGLTSRATWAQNIPTAIQQVRSLIGNEEFLDYMPSMKRFRKEEESEGAIW

SEQ ID NO: 4761 - protein, 3290 aa, Artificial Sequence
  derived and/or modified protein sequence (wt) from DENV-3__HM756279__SS-prME
TSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEATLPEEQDQNYVCKHTYVDRGWGNGCGLFGKGSLVTCAKFQCLEPIEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDVPCKIPFSTEDGQGKAHNGRLITANPVVTKKEEPVNIEAEPPFGESNTVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSVSRAWNVWEVEDYGFGVFTTNIWLKLREVYTQLCDHRLMSAAVKDERAVHADMGYWIESQKNGSWKLEKASLIEVKTCTWPKSHTLWSNGVLESDMIIPKSLAGPISQHNHRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGKVDNFTMGVLCLAILFEEVMRGKFGKKHMIAGVFFTFVLLLSGQITWRDMAHTLIMIGSNASDRMGMGVTYLALIATFKIQPFLALGFFLRKLTSRENLLLGVGLAMATTLQLPEDIEQMANGIALGLMALKLITQFETYQLWTALISLTCSNTIFTLTVAWRTATLILAGVSLLPVCQSSSMRKTDWLPMAVAAMGVPPLPLFIFGLKDTLKRRSWPLNEGVMAVGLVSILASSLLRNDVPMAGPLVAGGLLIACYVITGTSADLTVEKAADITWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGNFWETQVGVGVQKEGVFHTMWHVTRGAVLTYNGKRLEPNWASVKKDLISYGGGWRLSAQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLTVWLAHKVASEGIKYTDRKWCFDGQRNNQILEENMDVEIWTKEGEKKKLRPRWLDARTYSDPLALKEFKEFAAGRKSIALDLVTEIGRVPSHLAHRTRNALDNLVMLHTSEHGGRAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKDFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVASVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRSMPGTRRVMGITAEWLWRTLGRNKKPRLCTREEFTKKVRTNAAMGAVFTEENQWDSAKAAVEDEDFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPTGTVMDIISRKDQRGSGQVGTYGLNTFTNMEAQLIRQMEGEGVLSKADLENPHLPEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLKETACLGKAYAQMWSLMYFHRRDLRLASNAICSAVPVHWVPTSRTTWSIHAHHQWMTTEDMLTVWNRVWIEDNPWMEDKTPVTTWENVPYLGKREDQWCGSLIGLTSRATWAQNIPTAIQQVRSLIGNEEFLDYMPSMKRFRKEEESEGAIW

SEQ ID NO: 4762 - protein, 3290 aa, Artificial Sequence
  derived and/or modified protein sequence (wt) from DENV-3__HQ891025__SS-prME
TSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEATLPEEQDQNYVCKHTYVDRGWGNGCGLFGKGSLVTCAKFQCLEPIEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDVPCKIPFSTEDGQGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSVSRAWNVWEVEDYGFGVFTTNIWLKLREVYTQLCDHRLMSAAVKDERAVHADMGYWIESQKNGSWKLEKASLIEVKTCTWPKSHTLWSNGVLESDMIIPKSLAGPISQHNHRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGKVDNFTMGVLCLAILFEEVMRGKFGKKHMIAGVFFTFVLLLSGQITWRDMAHTLIMIGSNASDRMGMGVTYLALIATFKIQPFLALGFFLRKLTSRENLLLGVGLAMATTLQLPEDIEQMANGIALGLMALKLITQFETYQLWTALISLTCSNTIFTLTVAWRTATLILAGVSLLPVCQSSSMRKTDWLPMAVAAMGVPPLPLFIFGLKDTLKRRSWPLNEGVMAVGLVSILASSLLRNDVPMAGPLVAGGLLIACYVITGTSADLTVEKAADITWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTYNGKRLEPNWASVKKDLISYGGGWRLSAQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKEFAAGRKSIALDLVTEIGRVPSHLAHRTRNALDNLVMLHTSEHGGRAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKDFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVASVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRSMPGTRRVMGITAEWLWRTLGRNKKPRLCTREEFTKKVRTNAAMGAVFTEENQWDSAKAAVEDEDFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPTGTVMDIISRKDQRGSGQVGTYGLNTFTNMEAQLIRQMEGEGVLSKADLENPHLPEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLKETACLGKAYAQMWSLMNFHRRDLRLASNAICSAVPVHWVPTSRTTWSIHAHHQWMTTEDMLTVWNRVWIEDNPWMEDKTPVTTWENVPYLGKREDQWCGSLIGLTSRATWAQNIPTAIQQVRSLIGNEEFLDYMPSMKRFRKEEESEGAIW

SEQ ID NO: 4763 - protein, 3290 aa, Artificial Sequence
  derived and/or modified protein sequence (wt) from DENV-3__HQ705617__SS-prME
TSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEATLPEEQDQNYVCKHTYVDRGWGNGCGLFGKGSLVTCAKFQCLEPIEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDVPCKIPFSTEDGQGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSVSRAWNVWEVEDYGFGVFTTNIWLKLREVYTQLCDHRLMSAAVKDERAVHADMGYWIESQKNGSWKLEKASLIEVKTCTWPKSHTLWSNGVLESDMIIPKSLAGPISQHNHRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGKVDNFTMGVLCLAILFEEVMRGKFGKKHMIAGVFFTFVLLLSGQITWRDMAHTLIMIGSNASDRMGMGVTYLALIATFRIQPFLALGFFLRKLTSRENLLLGVGLAMATTLQLPEDIEQMANGIALGLMALKLITQFETYQLWTALISLTCSNTIFTLTVAWRTATLILAGVSLLPVCQSSSMRKTDWLPMAVAAMGVPPLPLFIFGLKDTLKRRSWPLNEGVMAVGLVSILASSLLRNDVPMAGPLVAGGLLIACYVITGTSADLTVEKAADITWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTYNGKRLEPNWASVKKDLISYGGGWRLSAQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKEFAAGRKSIALDLVTEIGRVPSHLAHRTRNALDNLVMLHTSEHGGRAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKDFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVASVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRSMPGTRRVMGITAEWLWRTLGRNKKPRLCTREEFTKKVRTNAAMGAVFTEENQWDSAKAAVEDEDFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPTGTVMDIISRKDQRGSGQVGTYGLNTFTNMEAQLIRQMEGEGVLSKADLENPHLPEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLKETACLGKAYAQMWSLMYFHRRDLRLASNAICSAVPVHWVPTSRTTWSIHAHHQWMTTEDMLTVWNRVWIEDNPWMEDKTPVTTWENVPYLGKREDQWCGSLIGLTSRATWAQNIPTAIQQVRSLIGNEEFLDYMPSMKRFRKEEESEGAIW

SEQ ID NO: 4764 - protein, 3290 aa, Artificial Sequence
  derived and/or modified protein sequence (wt) from DENV-3__HQ705619__SS-prME
TSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEATLPEEQDQNYVCKHTYVDRGWGNGCGLFGKGSLVTCAKFQCLEPIEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTETLTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDVPCKIPFSTEDGQGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSVSRAWNVWEVEDYGFGVFTTNIWLKLREVYTQLCDHRLMSAAVKDERAVHADMGYWIESQKNGSWKLEKASLIEVKTCTWPKSHTLWSNGVLESDMIIPKSLAGPISQHNHRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGKVDNFTMGVLCLAILFEEVMRGKFGKKHMIAGVFFTFVLLLSGQITWRDMAHTLIMIGSNASDRMGMGVTYLALIATFKIQPFLALGFFLRKLTSRENLLLGVGLAMATTLQLPEDIEQMANGIALGLMALKLITQFETYQLWTALISLTCSNTIFTLTVAWRTATLILAGVSLLPVCQSSSMRKTDWLPMAVAAMGVPPLPLFIFGLKDTLKRRSWPLNEGVMAVGLVSILASSLLRNDVPMAGPLVAGGLLIACYVITGTSADLTVEKAADITWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTYNGKRLEPNWASVKKDLISYGGGWRLSAQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKEFAAGRKSIALDLVTEIGRVPSHLAHRTRNALDNLVMLHTSEHGGRAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKDFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVASVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRSMPGTRRVMGITAEWLWRTLGRNKKPRLCTREEFTKKVRTNAAMGAVFTEENQWDSAKAAVEDEDFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPTGTVMDIISRKDQRGSGQVGTYGLNTFTNMEAQLIRQMEGEGVLSKADLENPHLPEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLKETACLGKAYAQMWSLMYFHRRDLRLASNAICSAVPVHWVPTSRTTWSIHAHHQWMTTEDMLTVWNRVWIEDNPWMEDKTPVTTWENVPYLGKREDQWCGSLIGLTSRATWAQNIPTAIQQVRSLIGNEEFLDYMPSMKRFRKEEESEGAIW

SEQ ID NO: 4765 - protein, 3290 aa, Artificial Sequence
  derived and/or modified protein sequence (wt) from DENV-3__HQ705620__SS-prME
TSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEATLPEEQDQNYVCKHTYVDRGWGNGCGLFGKGSLVTCAKFQCLEPIEGKVVQHENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDVPCKIPFSTEDGQGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWVGLNSKNTSMSFSCIAIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSVSRAWNVWEVEDYGFGVFTTNIWLKLREVYTQLCDHRLMSAAVKDERAVHADMGYWIESQKNGSWKLEKASLIEVKTCTWPKSHTLWSNGVLESDMIIPKSLAGPISQHNHRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGKVDNFTMGVLCLAILFEEVMRGKFGKKHMIAGVFFTFVLLLSGQITWRDMAHTLIMIGSNASDRMGMGVTYLALIATFKIQPFLALGFFLRRLTSRENLLLGVGLAMATTLQLPEDIEQMANGIALGLMALKLITQFETYQLWTALISLTCSNTIFTLTVAWRTATLILAGVSLLPVCQSSSMRKTDWLPMAVAAMGVPPLPLFIFSLKDTLKRRSWPLNEGVMAVGLVSILASSLLRNDVPMAGPLVAGGLLIACYVITGTSADLTVEKAADITWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTYNGKRLEPNWASVKKDLISYGGGWRLSAQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKEFAAGRKSIALDLVTEIGRVPSHLAHRTRNALDNLVMLHTSEHGGRAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKRKLNQLSRKDFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVASVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRSMPGTRRVMGITAEWLWRTLGRNKKPRLCTREEFTKKVRTNAAMGAVFTEENQWDSAKAAVEDEDFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPTGTVMDIISRKDQRGSGQVGTYGLNTFTNMEAQLIRQMEGEGVLSKADLENPHLPEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLKETACLGKAYAQMWSLMYFHRRDLRLASNAICSAVPVHWVPTSRTTWSIHAHHQWMTTEDMLTVWNRVWIEDNPWMEDKTPVTTWENVPYLGKREDQWCGSLIGLTSRATWAQNIPTAIQQVRSLIGNEEFLDYMPSMKRFRKEEESEGAIW

SEQ ID NO: 4766 - protein, 3290 aa, Artificial Sequence
  derived and/or modified protein sequence (wt) from DENV-3__HQ705621__SS-prME
TSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEATLPEEQDQNYVCKHTYVDRGWGNGCGLFGKGSLVTCAKFQCLEPIEGKVVQHENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDVPCKIPFSTEDGQGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSVSRAWNVWEVEDYGFGVFTTNIWLKLREVYTQLCDHRLMSAAVKDERAVHADMGYWIESQKNGSWKLEKASLIEVKTCTWPKSHTLWSNGVLESDMIIPKSLAGPISQHNHRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGKVDNFTMGVLCLAILFEEVMRGKFGKKHMIAGVFFTFVLLLSGQITWRDMAHTLIMIGSNASDRMGMGVTYLALIATFKIQPFLALGFFLRKLTSRENLLLGVGLAMATTLQLPEDIEQMANGIALGLMALKLITQFEIYQLWTALISLTCSNTIFTLTVAWRTATLILAGVSLLPMCQSSSMRKTDWLPMAVAAMGVPPLPLFIFSLKDTLKRRSWPLNEGVMAVGLVSILASSLLRNDVPMAGPLVAGGLLIACYVITGTSADLTVEKAADITWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTYNGKRLEPNWASVKKDLISYGGGWRLSAQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKEFAAGRKSIALDLVTEIGRVPSHLAHRTRNALDNLVMLHTSEHGGRAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCVVQLLLMRTSWALCEALTLATGPITTLWEGSPGKFWNTTIAVSMANIFRGSYLAGAGLAFSIMKSVGTGKRGTGSQGETLGEKWKKKLNQLSRKDFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVASVNMVSRLLLNRFTMTHRRPTIEKDVDLGAGTRHVNAEPETPNMDVIGERIKRIKEEHNSTWHHDDENPYKTWAYHGSYEVKATGSASSMINGVVKLLTKPWDVVPMVTQMAMTDTTPFGQQRVFKEKVDTRTPRSMPGTRRVMGITAEWLWRTLGRNKKPRLCTREEFTKKVRTNAAMGAVFTEENQWDSAKAAVEDEDFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPTGTVMDIISRKDQRGSGQVGTYGLNTFTNMEAQLIRQMEGEGVLSKADLENPHLPEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLKETACLGKAYAQMWSLMYFHRRDLRLASNAICSAVPVHWVPTSRTTWSIHAHHQWMTTEDMLTVWNRVWIEDNPWMEDKTPVTTWENVPYLGKREDQWCGSLIGLTSRATWAQNIPTAIQQVRSLIGNEEFLDYMPSMKRFRKEEESEGAIW

SEQ ID NO: 4767 - protein, 3290 aa, Artificial Sequence
  derived and/or modified protein sequence (wt) from DENV-3__HQ671176__SS-prME
TSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEATLPEEQDQNYVCKHTYVDRGWGNGCGLFGKGSLVTCAKFQCLEPIEGKVVQHENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDVPCKIPFSTEDGQGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSVSRAWNVWEVEDYGFGVFTTNIWLKLREVYTQLCDHRLMSAAVKDERAVHADMGYWIESQKNGSWKLEKASLIEVKTCTWPKSHTLWSNGVLESDMIIPKSLAGPISQHNHRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGKVDNFTMGVLCLAILFEEVMRGKFGKKHMIAGVFFTFVLLLSGQITWRDMAHTLIMIGSNASDRMGMGVTYLALIATFKIQPFLALGFFLRKLTSRENLLLGVGLAMATTLQLPEDIEQMANGIALGLMALKLITQFEIYQLWTALISLTCSNTIFTLTVAWRTATLILAGVSLLPMCQSSSMRKTDWLPMAVAAMGVPPLPLFIFSLKDTLKRRSWPLNEGVMAVGLVSILASSLLRNDVPMAGPLVAGGLLIACYVITGTSADLTVEKAADITWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTYNGKRLEPNWASVKKDLISYGGGWRLSAQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIVMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKEFAAGRKSIALDLVTEIGRVPSHLAHRTRNALDNLVMLHTSEHGGRAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKDFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVASVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRSMPGTRRVMGITAEWLWRTLGRNKKPRLCTREEFTKKVRTNAAMGAVFTEENQWDSAKAAVEDEDFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPTGTVMDIISRKDQRGSGQVGTYGLNTFTNMEAQLIRQMEGEGVLSKADLENPHLPEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLKETACLGKAYAQMWSLMYFHRRDLRLASNAICSAVPVHWVPTSRTTWSIHAHHQWMTTEDMLTVWNRVWIEDNPWMEDKTPVTTWENVPYLGKREDQWCGSLIGLTSRATWAQNIPTAIQQVRSLIGNEEFLDYMPSMKRFRKEEESEGAIW

SEQ ID NO: 4768 - protein, 3290 aa, Artificial Sequence
  derived and/or modified protein sequence (wt) from DENV-3__HQ705609__SS-prME
TSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEATLPEEQDQNYVCKHTYVDRGWGNGCGLFGKGSLVTCAKFQCLEPIEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDVPCKIPFSTEDGQGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQADMGCVVNWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPKELKYSWKTWGKAKIVTAETQNSSFIIDGPNTPECPSVSRAWNVWEVEDYGFGVFTTNIWLKLREVYTQLCDHRLMSAAVKDERAVHADMGYWIESQKNGSWKLEKASLIEVKTCTWPKSHTLWSNGVLESDMIIPKSLAGPISQHNHRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGKVDNFTMGVLCLAILFEEVMRGKFGKKHMIAGVFFTFVLLLSGQITWRDMAHTLIMIGSNASDRMGMGVTYLALIATFKIQPFLALGFFLRKLTSRENLLLGVGLAMATTLQLPEDIEQMANGIALGLMALKLITQFETYQLWTALISLTCSNTIFTLTVAWRTATLILAGVSLLPVCQSSSMRKTDWLPMAVAAMGVPPLPLFIFSLKDTLKRRSWPLNEGVMAVGLVSILASSLLRNDVPMAGPLVAGGLLIACYVITGTSADLTVEKAADITWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTYNGKRLEPNWASVKKDLISYGGGWRLSAQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKEFAAGRKSIALDLVTEIGRVPSHLAHRTRNALDNLVMLHTSEHGGRAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKDFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPIVEESRTIRVLKMVEPWLKNNQFCIKVLNPYMPTVIEHLERLQRKHGGMLVRNPLSRNSTHEMYWISNGTGNIVASVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFREKVDTRTPRSMPGTRRVMGITAEWLWRTLGRNKKPRLCTREEFTKKVRTNAAMGAVFTEENQWDSAKAAVEDEDFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPTGTVMDIISRKDQRGSGQVGTYGLNTFTNMEAQLIRQMEGEGVLSKADLENPHLPEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLKETACLGKAYAQMWSLMYFHRRDLRLASNAICSAVPVHWVPTSRTTWSIHAHHQWMTTEDMLTVWNRVWIEDNPWMEDKTPVTTWENVPYLGKREDQWCGSLIGLTSRATWAQNIPTAIQQVRSLIGNEEFLDYMPSMKRFRKEEESEGAIW

SEQ ID NO: 4769 - protein, 3290 aa, Artificial Sequence
  derived and/or modified protein sequence (wt) from DENV-3__HQ705610__SS-prME
TSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEATLPEEQDQNYVCKHTYVDRGWGNGCGLFGKGSLVTCAKFQCLEPIEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDVPCKIPFSTEDGQGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSVSRAWNVWEVEDYGFGVFTTNIWLKLREVYTQLCDHRLMSAAVKDERAVHADMGYWIESQKNGSWKLEKASLIEVKTCTWPKSHTIWSNGVLESDMIIPKSLAGPISQHNHRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGKVDNFTMGVLCLAILFEEVMRGKFGKKHMIAGVFLTFVLLLSGQITWKDMAHTLIMIGSNASDRMGMGVTYLALIATFKIQPFLALGFFLRKLTSRENLLLGVGLAMATTLQLPEDIEQMANGIALGLMALKLITQFETYQLWTALISLTCSNTISTLTVAWRTATLILAGVSLLPVCQSSSMRKTDWLPMAVAAMGVPPLPLFIFSLKDTLKRRSWPLNEGVMAVGLVSILASSLLRNDVPMAGPLVAGGLLIACYVITGTSADLTVEKAADITWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTYNGKRLEPNWASVKKDLISYGGGWRLSAQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKEFAAGRKSIALDLVTEIGRVPSHLAHRTRNALDNLVMLHTSEHGGRAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCVVQLLLMRTSWALCEALTLATGPITTLWEGSPGKFWNTTIAVSMANIFRGSYLAGAGLAFSIMKSVGTGKRGTGSQGETLGEKWKKKLNQLSRKDFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVASVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRSMPGTRRVMGITAEWLWRTLGRNKKPRLCTREEFTKKVRTNAAMGAVFTEENQWDSAKAAVEDEDFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPTGTVMDIISRKDQRGSGQVGTYGLNTFTNMEAQLIRQMEGEGVLSKADLENPHLPEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLKETACLGKAYAQMWSLMYFHRRDLRLASNAICSAVPVHWVPTSRTTWSIHAHHQWMTTEDMLTVWNRVWIEDNPWMEDKTPVTTWENVPYLGKREDQWCGSLIGLTSRATWAQNIPTAIQQVRSLIGNEEFLDYMPSMKRFRKEEESEGAIW

SEQ ID NO: 4770 - protein, 3290 aa, Artificial Sequence
  derived and/or modified protein sequence (wt) from DENV-3__HQ705611__SS-prME
TSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEATLPEEQDQNYVCKHTYVDRGWGNGCGLFGKGSLVTCAKFQCLEPIEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDVPCKIPFSTEDGQGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSVSRAWNVWEVEDYGFGVFTTNIWLKLREVYTQLCDHRLMSAAVKDERAVHADMGYWIESQKNGSWKLEKASLIEVKTCTWPKSHTLWSNGVLESDMIIPKSLAGPISQHNHRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGKVDNFTMGVLCLAILFEEVMRGKFGKKHMIAGVFFTFVLLLSGQITWRDMAHTLIMIGSNASDRMGMGVTYLALIATFKIQPFLALGFFLRKLTSRENLLLGVGLAMATTLQLPEDIEQMANGIALGLMALKLITQFETYQLWTALISLTCSNTIFTLTVAWRTATLILAGVSLLPVCQSSSMRKTDWLPMAVAAMGVPPLPLFIFGLKDTLKRRSWPLNEGVMAVGLVSILASSLLRNDVPMAGPLVAGGLLIACYVITGTSADLTVEKAADITWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTYNGKRLEPNWASVKKDLISYGGGWRLSAQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKEFAAGRKSIALDLVTEIGRVPSHLAHRTRNALDNLVMLHTSEHGGRAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKDFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVASVNMVSRLLLNRFTMTHRRPTIEKDVDLGAGTRHVNAEPETPNMDVIGERIKKIKEEHNSTWHYDDENPYKTWAYHGSYEVKATGSASSMINGVVKLLTKPWDVVPMVTQMAMTDTTPFGQQRVFKEKVDTRTPRSMPGTRRVMGITAEWLWRTLGRNKKPRLCTREEFTKKVRTNAAMGAVFTEENQWDSAKAAVEDEDFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPTGTVMDIISRKDQRGSGQVGTYGLNTFTNMEAQLIRQMEGEGVLSKADLENPHLPEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLKETACLGKAYAQMWSLMYFHRRDLRLASNAICSAVPVHWVPTSRTTWSIHAHHQWMTTEDMLTVWNRVWIEDNPWMEDKTPVTTWENVPYLGKREDQWCGSLIGLTSRATWAQNIPTAIQQVRSLIGNEEFLDYMPSMKRFRKEEESEGAIW

SEQ ID NO: 4771 - protein, 3290 aa, Artificial Sequence
  derived and/or modified protein sequence (wt) from DENV-3__HQ705612__SS-prME
TSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEATLPEEQDQNYVCKHTYVDRGWGNGCGLFGKGSLVTCAKFQCLEPIEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDVPCKIPFSTEDGQGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSVSRAWNVWEVEDYGFGVFTTNIWLKLREVYTQLCDHRLMSAAVKDERAVHADMGYWIESQKNGSWKLEKASLIEVKTCTWPKSHTLWSNGVLESDMIIPKSLAGPISQHNHRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGKVDNFTMGVLCLAILFEEVMRGKFGKKHMIAGVFFTFVLLLSGQITWRDMAHTLIMIGSNASDRMGMGVTYLALIATFKIQPFLALGFFLRKLTSRENLLLGVGLAMATTLQLPEDIEQMANGIALGLMALKLITQFETYQLWTALISLTCSNTIFTLTVAWRTATLILAGVSLLPVCQSSSMRKTDWLPMAVAAMGVPPLPLFIFGLKDTLKRRSWPLNEGVMAVGLVSILASSLLRNDVPMAGPLVAGGLLIACYVITGTSADLTVEKAADTTWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTHNGKRLEPNWASVKKDLISYGGGWRLSAQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKEFAAGRKSIALDLVTEIGRVPSHLAHRTRNALDNLVMLHTSEHGGRAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKDFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVASVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRSMPGTRRVMGITAEWLWRTLGRNKKPRLCTREEFTKKVRTNAAMGAVFTEENQWDSAKAAVEDEDFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPTGTVMDIISRKDQRGSGQVGTYGLNTFTNMEAQLIRQMEGEGVLSKADLENPHLPEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLKETACLGKAYAQMWSLMYFHRRDLRLASNAICSAVPVHWVPTSRTTWSIHAHHQWMTTEDMLTVWNRVWIEDNPWMEDKTPVTTWENVPYLGKREDQWCGSLIGLTSRATWAQNIPTAIQQVRSLIGNEEFLDYMPSMKRFRKEEESEGAIW

SEQ ID NO: 4772 - protein, 3290 aa, Artificial Sequence
  derived and/or modified protein sequence (wt) from DENV-3__HQ705613__SS-prME
TSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEATLPEEQDQNYVCKHTYVDRGWGNGCGLFGKGSLVTCAKFQCLEPIEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDVPCKIPFSTEDGQGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSVSRAWNVWEVEDYGFGVFTTNIWLKLREVYTQLCDHRLMSAAVKDERAVHADMGYWIESQKNGSWKLEKASLIEVKTCTWPKSHTLWSNGVLESDMIIPKSLAGPISQHNHRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGKVDNFTMGVLCLAILFEEVMRGKFGKKHMIAGVFFTFVLLLSGQITWRDMAHTLIMIGSNASDRMGMGVTYLALIATFKIQPFLALGFFLRKLTSRENLLLGVGLAMATTLQLPEDIEQMANGIALGLMALKLITQFETYQLWTALISLTCSNTIFTLTVAWRTATLILAGVSLLPVCQSSSMRKTDWLPMAVAAMGVPPLPLFIFGLKDTLKRRSWPLNEGVMAVGLVSILASSLLRNDVPMAGPLVAGGLLIACYVITGTSADLTVEKAADITWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTYNGKRLEPNWASVKKDLISYGGGWRLSAQWQKGEEVQVIAVEPGKNPKNYQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTTRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKEFAAGRKSIALDLVTEIGRVPSHLAHRTRNALDNLVMLHTSEHGGRAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKDFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVASVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRSMPGTRRVMGITAEWLWRTLGRNKKPRLCTREEFTKKVRTNAAMGAVFTEENQWDSAKAAVEDEDFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPTGTVMDIISRKDQRGSGQVGTYGLNTFTNMEAQLIRQMEGEGVLSKADLENPHLPEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLKETACLGKAYAQMWSLMYFHRRDLRLASNAICSAVPVHWVPTSRTTWSIHAHHQWMTTEDMLTVWNRVWIEDNPWMEDKTPVTTWENVPYLGKREDQWCGSLIGLTSRATWAQNIPTAIQQVRSLIGNEEFLDYMPSMKRFRKEEESEGAIW

SEQ ID NO: 4773 - protein, 3290 aa, Artificial Sequence
  derived and/or modified protein sequence (wt) from DENV-3__HQ705615__SS-prME
TSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEATLPEEQDQNYVCKHTYVDRGWGNGCGLFGKGSLVTCAKFQCLEPIEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDVPCKIPFSTEDGQGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSVSRAWNVWEVEDYGFGVFTTNIWLKLREVYTQLCDHRLMSAAVKDERAVHADMGYWIESQKNGSWKLEKASLIEVKTCTWPKSHTLWSNGVLESDMIIPKSLAGPISQHNHRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGKVDNFTMGVLCLAILFEEVMRGKFGKKHMIAGVFFTFVLLLSGQITWRDMAHTLIMIGSNASDRMGMGVTYLALIATFKIQPFLALGFFLRKLTSRENLLLGVGLAMATTLQLPEDIEQMANGIALGLMALKLITQFETYQLWTALISLTCSNTIFTLTVAWRTATLILAGVSLLPVCQSSSMRKTDWLPMAVAAMGVPPLPLFIFSLKDTLKRRSWPLNEGVMAVGLVSILASSLLRNDVPMAGPLVAGGLLIACYVITGTSADLTVEKAADITWEEEAEQTGVSHNLMIAVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTYNGKRLEPNWASVKKDLISYGGGWRLSAQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKEFAAGRKSIALDLVTEIGRVPSHLAHRTRNALDNLVMLHTSEHGGRAYRHAVEELPETMETLLLLGLMILLTGGAMLFLISGKGIGKTSIGLICVITSSGMLWMAEIPLQWIASAIVLEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKDFDLYKKSGITEVDRTEAKEGLKRGEITHHAVSRGSAKLQWFVERNMVIPEGRVIDLGCGRGGWSYHCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVASVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRSMPGTRRVMGITAEWLWRTLGRNKKPRLCTREEFTKKVRTNAAMGAVFTEENQWDSAKAAVEDEDFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPTGTVMDIISRKDQRGSGQVGTYGLNTFTNMEAQLIRQMEGEGVLSKADLENPHLPEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLKETACLGKAYAQMWSLMYFHRRDLRLASNAICSAVPVHWVPTSRTTWSIHAHHQWMTTDDMLTVWNRVWIEDNPWMEDKTPVTTWENVPYLGKREDQWCGSLIGLTSRATWAQNIPTAIQQVRSLIGNEEFLDYMPSMKRFRKEEESEGAIW

SEQ ID NO: 4774 - protein, 3290 aa, Artificial Sequence
  derived and/or modified protein sequence (wt) from DENV-3__JF920398__SS-prME
TSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEATLPEEQDQNYVCKHTYVDRGWGNGCGLFGKGSLVTCAKFQCLEPIEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDVPCKIPFSTEDGQGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSVSRAWNVWEVEDYGFGVFTTNIWLKLREVYTQLCDHRLMSAAVKDERAVHADMGYWIESQKNGSWKLEKASLIEVKTCTWPKSHTIWSNGVLESDMIIPKSLAGPISQHNHRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGKVDNFTMGVLCLAILFEEVMRGKFGKKHMIAGVFLTFVLLLSGQITWRDMAHTLIMIGSNASDRMGMGVTYLALIATFKIQPFLALGFFLRKLTSRENLLLGVGLAMATTLQLPEDIEQMANGIALGLMALKLITQFETYQLWTALISLTCSNTIFTLTVAWRTATLILAGVSLLPVCQSSSMRKTDWLPMAVAAMGVPPLPLFIFSLKDTLKRRSWPLNEGVMAVGLVSILASSLLRNDVPMAGPLVAGGLLIACYVITGTSADLTVEKAADITWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTYNGKRLEPNWASVKKDLISYGGGWRLSAQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKEFAAGRKSIALDLVTEIGRVPSHLAHRTRNALDNLVMLHTSEHGGRAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKDFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVASVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRSMPGTRRVMGITAEWLWRTLGRNKKPRLCTREEFTKKVRTNAAMGAVFTEENQWDSAKAAVEDEDFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPTGTVMDIISRKDQRGSGQVGTYGLNTFTNMEAQLIRQMEGEGVLSKADLENPHLPEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLKETACLGKAYAQMWSLMYFHRRDLRLASNAICSAVPVHWVPTSRTTWSIHAHHQWMTTEDMLTVWNRVWIEDNPWMEDKTPVTTWENVPYLGKREDQWCGSLIGLTSRATWAQNIPTAIQQVRSLIGNEEFLDYMPSMKRFRKEEESEGAIW

SEQ ID NO: 4775 - protein, 3290 aa, Artificial Sequence
  derived and/or modified protein sequence (wt) from DENV-3__JF920402__SS-prME
TSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEATLPEEQDQNYVCKHTYVDRGWGNGCGLFGKGSLVTCAKFQCLEPIEGKVVQHENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDVPCKIPFSTEDGQGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSVSRAWNVWEVEDYGFGVFTTNIWLKLREVYTQLCDHRLMSAAVKDERAVHADMGYWIESQKNGSWKLEKASLIEVKTCTWPKSHTLWSNGVLESDMIIPKSLAGPISQHNHRPGYHTQTAGPWHLGKLELDFNYCEGTTVVITENCGARGPSLRTTTVSGKLIHEWCCRSCTLPPLRYMGEDGCWYGMEIRPISEKEENMVKSLVSAGSGKVDNFTMGVLCLAILFEEVMRGKFGKKHMIAGVFFTFVLLLSGQITWRDMAHTLIMIGSNASDRMGMGVTYLALIATFKIQPFLALGFFLRKLTSRENLLLGVGLAMATTLQLPEDIEQMANGIALGLMALKLITQFEIYQLWTALISLTCSNTIFTLTVAWRTATLILAGVSLLPMCQSSSMRKTDWLPMAVAAMGVPPLPLFIFSLKDTLKRRSWPLNEGVMAVGLVSILASSLLRNDVPMAGPLVAGGLLIACYVITGTSADLTVEKAADITWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTYNGKRLEPNWASVKKDLISYGGGWRLSAQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKEFAAGRKSIALDLVTEIGRVPSHLAHRTRNALDNLVMLHTSEHGGRAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCVVQLLLMRTSWALCEALTLATGPITTLWEGSPGKFWNTTIAVSMANIFRGSYLAGAGLAFSIMKSVGTGKRGTGSQGETLGEKWKKKLNQLSRKDFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVASVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRSMPGTRRVMGITAEWLWRTLGRNKKPRLCTREEFTKKVRTNAAMGAVFTEENQWDSAKAAVEDEDFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPTGTVMDIISRKDQRGSGQVGTYGLNTFTNMEAQLIRQMEGEGVLSKADLENPHLPEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLKETACLGKAYAQMWSLMYFHRRDLRLASNAICSAVPVHWVPTSRTTWSIHAHHQWMTTEDMLTVWNRVWIEDNPWMEDKTPVTTWENVPYLGKREDQWCGSLIGLTSRATWAQNIPTAIQQVRSLIGNEEFLDYMPSMKRFRKEEESEGAIW

SEQ ID NO: 4776 - protein, 3290 aa, Artificial Sequence
  derived and/or modified protein sequence (wt) from DENV-3__JF937652__SS-prME
TSLCLMMILPAALAFHLTSRDGEPRMIVGKNERGKSLLFKTASGINMCTLIAMDLGEMCDNTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEATLPEEQDQNYVCKHTYVDRGWGNGCGLFGKGSLVTCAKFQCLEPIEGKVVQYENLKYTVIITVHTGDQHQVGNETQGVTAEITPQASTTEAVLPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDVPCKIPFSTEDGQGKAHNGRLITANPVVTKKEELVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSVSRAWNVWEVEDYGFGVFTTNIWLKLREVYTQLCDHRLMSAAVKDERAVHADMGYWIESQKNGSWKLEKASLIEVKTCTWPKSHTLWSNGVLESDMIIPKSLAGPISQHNYRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGKVDNFTMGVLCLAILFEEVMRGKLGKKHMIAGVFFTFVLLLSGQITWRDMAHTLIMIGSNASDRMGMGVTYLALIATFKIQPFLALGFFLRKLTSRENLLLGVGLAMATTLQLPEDIEQMANGIALGLMALKLITQFETYQLWTALISLTCSNTIFTLTVAWRTATLILAGVSLLPVCQSSSMRKTDWLPMAVAAMGVPPLPLFIFGLKDTLKRRSWPLNEGVMAVGLVSILASSLLRNDVPMAGPLVAGGLLIACYVITGTSADLTVEKAADITWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTYNGKRLEPNWASVKKDLISYGGGWRLSAQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEEKDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKEFAAGRKSIALDLVTEIGRVPSHLAHRTRNALDNLVMLHTSEHGGRAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKDFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVASVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRSMPGTRRVMGITAEWLWRTLGRNKKPRLCTREEFTKKVRTNAAMGAVFTEENQWDSAKAAVEDEDFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPTGTVMDIISRKDQRGSGQVGTYGLNTFTNMGAQLIRQMEGEGVLSKADLENPHLPEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLKETACLGKAYAQMWSLMYFHRRDLRLASNAICSAVPVHWVPTSRTTWSIHAHHQWMTTEDMLTVWNRVWIEDNPWMEDKTPVTTWENVPYLGKREDQWCGSLIGLTSRATWAQNIPTAIQQVRSLIGNEEFLDYMPSMKRFRKEEESEGAIW

SEQ ID NO: 4777 - protein, 3290 aa, Artificial Sequence
  derived and/or modified protein sequence (wt) from DENV-3__JF920404__SS-prME
TSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEATLPEEQDQNYVCKHTYVDRGWGNGCGLFGKGSLVTCAKFQCLEPIEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNAFVLKKEVSETQHGTILIKVEYKGEDVPCKIPFSTEDGQGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSVSRAWNVWEVEDYGFGVFTTNIWLKLREVYTQLCDHRLMSAAVKDERAVHADMGYWIESQKNGSWKLEKASLIEVKTCTWPKSHTLWSNGVLESDMIIPKSLAGPISQHNHRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGKVDNFTMGVLCLAILFEEVMRGKFGKKHMIAGVFFTFVLLLSGQITWRDMAHTLIMIGSNASDRMGMGVTYLALIATFKIQPFLALGFFLRKLTSRENLLLGVGLAMATTLQLPEDIEQMANGIALGLMALKLITQFETYQLWTALISLTCSNTIFTLTVAWRTATLILAGVSLLPVCQSSSMRKTDWLPMAVAAMGVPPLPLFIFGLKDTLKRRSWPLNEGVMAVGLVSILASSLLRNDVPMAGPLVAGGLLIACYVITGTSADLTVEKAADITWEEGAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTYNGKRLEPNWASVKKDLISYGGGWRLSAQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKEFAAGRKSIALDLVTEIGRVPSHLAHRTRNALDNLVMLHTSEHGGRAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKDFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVASVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRSMPGTRRVMGITAEWLWRTLGRNKKPRLCTREEFTKKVRTNAAMGAVFTEENQWDSAKAAVEDEDFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPTGTVMDIISRKDQRGSGQVGTYGLNTFTNMEAQLIRQMEGEGVLSKADLENPHLPEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLKETACLGKAYAQMWSLMYFHRRDLRLASNAICSAVPVHWVPTSRTTWSIHAHHQWMTTEDMLTVWNRVWIEDNPWMEDKTPVTTWENVPYLGKREDQWCGSLIGLTSRATWAQNIPTAIQQVRSLIGNEEFLDYMPSMKRFRKEEESEGAIW

SEQ ID NO: 4778 - protein, 3290 aa, Artificial Sequence
  derived and/or modified protein sequence (wt) from DENV-3__JF937641__SS-prME
TSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEATLPEEQDQNYVCKHTYVDRGWGNGCGLFGKGSLVTCAKFQCLEPIEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNAFVLKKEVSETQHGTILIKVEYKGEDVPCKIPFSTEDGQGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSVSRAWNVWEVEDYGFGVFTTNIWLKLREVYTQLCDHRLMSAAVKDERAVHADMGYWIESQKNGSWKLEKASLIEVKTCTWPKSHTLWSNGVLESDMIIPKSLAGPISQHNHRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGKVDNFTMGVLCLAILFEEVMRGKFGKKHMIAGVFFTFVLLLSGQITWRDMAHTLIMIGSNASDRMGMGVTYLALIATFKIQPFLALGFFLRKLTSRENLLLGVGLAMATTLQLPEDIEQMANGIALGLMALKLITQFETYQLWTALISLTCSNTIFTLTVAWRTATLILAGVSLLPVCQSSSMRKTDWLPMAVAAMGVPPLPLFIFGLKDTLKRRSWPLNEGVMAVGLVSILASSLLRNDVPMAGPLVAGGLLIACYVITGTSADLTVEKAADITWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTYNGKRLEPNWASVKKDLISYGGGWRLSAQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKEFAAGRKSIALDLVTEIGRVPSHLAHRTRNALDNLVMLHTSEHGGRAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKDFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVASVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRSMPGTRRVMGITAEWLWRTLGRNKKPRLCTREEFTKKVRTNAAMGAVFTEENQWDSAKAAVEDEDFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPTGTVMDIISRKDQRGSGQVGTYGLNTFTNMEAQLIRQMEGEGVLSKADLENPHLPEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLKETACLGKAYAQMWSLMYFHRRDLRLASNAICSAVPVHWVPTSRTTWSIHAHHQWMTTEDMLTVWNRVWIEDNPWMEDKTPVTTWENVPYLGKREDQWCGSLIGLTSRATWAQNIPTAIQQVRSLIGNEEFLDYMPSMKRFRKEEESEGAIW

SEQ ID NO: 4779 - protein, 3290 aa, Artificial Sequence
  derived and/or modified protein sequence (wt) from DENV-3__JF920396__SS-prME
TSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEATLPEEQDQNYVCKHTYVDRGWGNGCGLFGKGSLVTCAKFQCLEPIEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDVPCKIPFSTEDGQGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGALLTWIGLNSKNTSMSFSCIAIGIITLYLGAVVQADMGCVVNWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSVSRAWNVWEVEDYGFGVFTTNIWLKLREVYTQLCDHRLMSAAVKDERAVHADMGYWIESQKNGSWKLEKASLIEVKTCTWPKSHTLWSNGVLESDMIIPKSLAGPISQHNHRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGKVDNFTMGVLCLAILFEEVMRGKFGKKHMIAGVFFTFVLLLSGQITWRDMAHTLIMIGSNASDRMGMGVTYLALIATFKIQPFLALGFFLRKLTSRENLLLGVGLAMATTLQLPEDIEQMANGIALGLMALKLITQFETYQLWTALISLTCSNTIFTLTVAWRTATLILAGVSLLPVCQSSSMRKTDWLPMAVAAMGVPPLPLFIFSLKDTLKRRSWPLNEGVMAVGLVSILASSLLRNDVPMAGPLVAGGLLIACYVITGTSADLTVEKAADITWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTYNGKRLEPNWASVKKDLISYGGGWRLSAQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKEFAAGRKSIALDLVTEIGRVPSHLAHRTRNALDNLVMLHTSEHGGRAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKDFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVASVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRSMPGTRRVMGITAEWLWRTLGRNKKPRLCTREEFTKKVRTNAAMGAVFTEENQWDSAKAAVEDEDFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPTGTVMDIISRKDQRGSGQVGTYGLNTFTNMEAQLIRQMEGEGVLSKADLENPHLPEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLKETACLGKAYAQMWSLMYFHRRDLRLASNAICSAVPVHWVPTSRTTWSIHAHHQWMTTEDMLTVWNRVWIEDNPWMEDKTPVTTWENVPYLGKREDQWCGSLIGLTSRATWAQNIPTAIQQVRSLIGNEEFLDYMPSMKRFRKEEESEGAIW

SEQ ID NO: 4780 - protein, 3290 aa, Artificial Sequence
  derived and/or modified protein sequence (wt) from DENV-3__JF920406__SS-prME
TSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEATLPEEQDQNYVCKHTYVDRGWGNGCGLFGKGSLVTCAKFQCLEPIEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNAFVLKKEVSETQHGTILIKVEYKGEDVPCKIPFSTEDGQGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSVSRAWNVWEVEDYGFGVFTTNIWLKLREVYTQLCDHRLMSAAVKDERAVHADMGYWIESQKNGSWKLEKASLIEVKTCTWPKSHTLWSNGVLESDMIIPKSLAGPISQHNHRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGKVDNFTMGVLCLAILFEEVMRGKFGKKHMIAGVFFTFVLLLSGQITWRDMAHTLIMIGSNASDRMGMGVTYLALIATFEIQPFLALGFFLRKLTSRENLLLGVGLAMATTLQLPEDIEQMANGIALGLMALKLITQFETYQLWTALISLTCSNTIFTLTVAWRTATLILAGVSLLPVCQSSSMRKTDWLPMAVAAMGVPPLPLFIFGLKDTLKRRSWPLNEGVMAVGLVSILASSLLRNDVPMAGPLVAGGLLIACYVITGTSADLTVEKAADITWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTYNGKRLEPNWASVKKDLISYGGGWRLSAQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKEFAAGRKSIALDLVTEIGRVPSHLAHRTRNALDNLVMLHTSEHGGRAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKDFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVASVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRSMPGTRRVMGITAEWLWRTLGRNKKPRLCTREEFTKKVRTNAAMGAVFTEENQWDSAKAAVEDEDFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPTGTVMDIISRKDQRGSGQVGTYGLNTFTNMEAQLIRQMEGEGVLSKADLENPHLPEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLKETACLGKAYAQMWSLMYFHRRDLRLASNAICSAVPVHWVPTSRTTWSIHAHHQWMTTEDMLTVWNRVWIEDNPWMEDKTPVTTWENVPYLGKREDQWCGSLIGLTSRATWAQNIPTAIQQVRSLIGNEEFLDYMPSMKRFRKEEESEGAIW

SEQ ID NO: 4781 - protein, 3290 aa, Artificial Sequence
  derived and/or modified protein sequence (wt) from DENV-3__JF920409__SS-prME
TSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLAQKVVIFILLMLVTPSMTMRCVGVGNRDFVEGLSGATWVDVVLEHGGCVTTMAKNKPTLDIELQKTEATQLATLRKLCIEGKITNITTDSRCPTQGEATLPEEQDQNYVCKHTYVDRGWGNGCGLFGKGSLVTCAKFQCLEPIEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDVPCKIPFSTEDGQGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSVSRAWNVWEVEDYGFGVFTTNIWLKLREVYTQLCDHRLMSAAVKDERAVHADMGYWIESQKNGSWKLEKASLIEVKTCTWPKSHTLWSNGVLESDMIIPKSLAGPISQHNHRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGKVDNFTMGVLCLAILFEEVMRGKFGKKHMIAGAFFMFVLLLSGQITWRDMAHTLIMIGSNASDRMGMGVTYLALIATFKIQPFLALGFFLRKLTSRENLLLGVGLAMATTLQLPEDIEQMANGIALGLMALKLITQFETYQLWTALISLTCSNTIFTLTVAWRTATLILAGVSLLPVCQSSSMRKTDWLPMAVAAMGVPPLPLFIFSLKDTLKRRSWPLNEGVMAVGLVSILASSLLRNDVPMAGPLVAGGLLIACYVITGTSADLTVEKAADITWEEEAEQTGVSHNLMITVDDDGTMRIKDDESENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTYNGKRLEPNWASVKKDLISYGGGWRLSAQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKEFAAGRKSIALDLVTEIGRVPSHLAHRTRNALDNLVMLHTSEHGGRAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKDFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVASVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRSMPGTRRVMGITAEWLWRTLGRNKKPRLCTREEFTKKVRTNAAMGAVFTEENQWDSAKAAVEDEDFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPTGTVMDIISRKDQRGSGQVGTYGLNTFTNMEAQLIRQMEGEGVLSKADLENPHLPEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLKETACLGKAYAQMWSLMYFHRRDLRLASNAICSAVPVHWVPTSRTTWSIHAHHQWMTTEDMLTVWNRVWIEDNPWMEDKTPVTTWENVPYLGKREDQWCGSLIGLTSRATWAQNIPTAIQQVRSLIGNEEFLDYMPSMKRFRKEEESEGAIW

SEQ ID NO: 4782 - protein, 3290 aa, Artificial Sequence
  derived and/or modified protein sequence (wt) from DENV-3__JF920408__SS-prME
TSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEATLPEEQDQNYVCKHTYVDRGWGNGCGLFGKGSLVTCAKFQCLEPIEGKVVQYENLKYTVIITVHTGDQHQVGNGTQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTGIFAGHLKCRLKMDKLELKGMSYAMCTNTFVLKKEVSETQHGTILIKVEYKGEDVPCKIPFSTEDGQGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSVSRAWNVWEVEDYGFGVFTTNIWLKLREVYTQLCDHRLMSAAVKDERAVHADMGYWIESQKNGSWKLEKASLIEVKTCTWPKSHTLWSNGVLESDMIIPKSLAGPISQHNHRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGKVDNFTMGVLCLAILFEEVMRGKFGKKHMIAGVFFTFVLLLSGQITWRDMAHTLIMIGSNASDRMGMGVTYLALIATFKIQPFLALGFFLRKLTSRENLLLGVGLAMATTLQLPEDIEQMANGIALGLMALKLITQFETYQLWTALISLTCSNTIFTLTVAWRTATLILAGVSLLPVCQSSSMRKTDWLPMAVAAMGVPPLPLFIFGLKDTLKRRSWPLNEGVMAVGLVSILASSLLRNDVPMAGPLVAGGLLIACYVITGTSADLTVEKAADITWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTYNGKRLEPNWASVKKDLISYGGGWRLSAQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKEFAAGRKSIALDLVTEIGRVPSHLAHRTRNALDNLVMLHTSEHGGRAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKDFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVASVNMVSRLLLNRFTMTHRRPTIEKDVDLGAGTRHVNAEPETPNMEVIGERIKRIKEEHNSTWHYDDENPYKTWAYHGSYEVKATGSASSMINGVVKLLTKPWDVVPMVTQMAMTDTTPFGQQRVFKEKVDTRTPRSMPGTRRVMGITAEWLWRTLGRNKKPRLCTREEFTKKVRTNAAMGAVFTEENQWDSAKAAVEDEDFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLADAIFKLTYQNKVVKVQRPTPTGTVMDIISRKDQRGSGQVGTYGLNTFTNMEAQLIRQMEGEGVLSKADLENPHLPEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLKETACLGKAYAQMWSLMYFHRRDLRLASNAICSAVPVHWVPTSRTTWSIHAHHQWMTTEDMLTVWNRVWIEDNPWMEDKTPVTTWENVPYLGKREDQWCGSLIGLTSRATWAQNIPTAIQQVRSLIGNEEFLDYMPSMKRFRKEEESEGAIW

SEQ ID NO: 4783 - protein, 3290 aa, Artificial Sequence
  derived and/or modified protein sequence (wt) from DENV-3__JF920397__SS-prME
TSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEATLPEEQDQNYVCKHTYVDRGWGNGCGLFGKGSLVTCAKFQCLEPIEGKVVQHENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKDLLVTFKNAHAKKQEVVVLGSQEGAMHTALTGATEIQNSGGTSIFAGHLKCRLKMDKLELKGMSYAMCTNTFVLKKEVSETQHGTILIKVEYKGEDVPCKIPFSTEDGQGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSVSRAWNVWEVEDYGFGVFTTNIWLKLREVYTQLCDHRLMSAAVKDERAVHADMGYWIESQKNGSWKLEKASLIEVKTCTWPKSHTLWSNGVLESDMIIPKSLAGPISQHNHRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGKVDNFTMGVLCLAILFEEVMRGKFGKKHMIAGVFFTFVLLLSGQITWRDMAHTLIMIGSNASDRMGMGVTYLALIATFKIQPFLALGFFLRKLTSRENLLLGVGLAMATTLQLPEDIEQMANGIALGLMALKLITQFEIYQLWTALISLTCSNTIFTLTVAWRTATLILAGVSLLPMCQSSSMRKTDWLPMAVAAMGVPPLPLFIFSLKDTLKRRSWPLNEGVMAVGLVSILASSLLRNDVPMAGPLVAGGLLIACYVITGTSADLTVEKAADITWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTYNGKRLEPNWASVKKDLISYGGGWRLSTQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKEFAAGRKSIALDLVTEIGRVPSHLAHRTRNALDNLVMLHTSEHGGRAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCVVQLLLMRTSWALCEALTLATGPITTLWEGSPGKFWNTTIAVSMANIFRGSYLAGAGLAFSIMKSVGTGKRGTGSQGETLGEKWKKKLNQLSRKDFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVASVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRSMPGTRRVMGITAEWLWRTLGRNKKPRLCTREEFTKKVRTNAAMGAVFTEENQWDSAKAAVEDEDFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPTGTVMDIISRKDQRGSGQVGTYGLNTFTNMEAQLIRQMEGEGVLSKADLENPHLPEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLKETACLGKAYAQMWSLMYFHRRDLRLASNAICSAVPVHWVPTSRTTWSIHAHHQWMTTEDMLTVWNRVWIEDNPWMEDKTPVTTWENVPYLGKREDQWCGSLIGLTSRATWAQNIPTAIQQVRSLIGNEEFLDYMPSMKRFRKEEESEGAIW

SEQ ID NO: 4784 - protein, 3290 aa, Artificial Sequence
  derived and/or modified protein sequence (wt) from DENV-3__JN093513__SS-prME
TSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEATLPEEQDQNYVCKHTYVDRGWGNGCGLFGKGSLVTCAKFQCLEPIEGKVVQHENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDVPCKIPFSTEDGQGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSVSRAWNVWEVEDYGFGVFTTNIWLKLREVYTQLCDHRLMSAAVKDERAVHADMGYWIESQKNGSWKLEKASLIEVKTCTWPKSHTLWSNGVLESDMIIPKSLAGPISQHNHRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGKVDNFTMGVLCLAILFEEVMRGKFGKKHMIAGVFFTFVLLLSGQITWRDMAHTLIMIGSNTSDRMGMGVTYLALIATFKIQPFLALGFFLRKLTSRENLLLGVGLAMATTLQLPEDIEQMANGIALGLMALKLITQFEIYQLWTALISLTCSNTIFTLTVAWRTATLILAGVSLLPVCQSSSMRKTDWLPMAVAAMGVPPLPLFIFGLKDTLKRRSWPLNEGVMAVGLVSILASSLLRNDVPMAGPLVAGGLLIACYVITGTSADLTVEKAADITWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTYNGKRLEPNWASVKKDLISYGGGWRLSAQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKEFAAGRKSIALDLVTEIGRVPSHLAHRTRNALDNLVMLHTSEHGGRAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKDFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVASVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRSMPGTRRVMGITAEWLWRTLGRNKKPRLCTREEFTKKVRTNAAMGAVFTEENQWDSAKAAVEDEDFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPTGTVMDIISRKDQRGSGQVGTYGLNTFTNMEAQLIRQMEGEGVLSKADLENPHLPEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLKETACLGKAYAQMWSLMYFHRRDLRLASNAICSAVPVHWVPTSRTTWSIHAHHQWMTTEDMLTVWNRVWIEDNPWMEDKTPVTTWENVPYLGKREDQWCGSLIGLTSRATWAQNIPTAIQQVRSLIGNEEFLDYMPSMKRFRKEEESEGAIW

SEQ ID NO: 4785 - protein, 3290 aa, Artificial Sequence
  derived and/or modified protein sequence (wt) from DENV-3__JF937624__SS-prME
TSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEATLPEEQDQNYVCKHTYVDRGWGNGCGLFGKGSLVTCAKFQCLEPIEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDVPCKIPFSTEDGQGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSVSRAWNVWEVEDYGFGVFTTNIWLKLREVYTQLCDHRLMSAAVKDERAVHADMGYWIESQKNGSWKLEKASLIEVKTCTWPKSHTLWSNGVLESDMIIPKSLAGPISQHNHRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGKVDNFTMGVLCLAILFEEVMRGKFGKKHMIAGVFFTFVLLLSGQITWRDMAHTLIMIGSNASDRMGMGVTYLALIATFKIQPFLALGFFLRKLTSRENLLLGVGLAMATTLQLPEDIEQMANGIALGLMALKLITQFETYQLWTALISLTCSNTIFTLTVAWRTATLILAGVSLLPVCQSSSMRKTDWLPMAVAAMGVPPLPLFIFGLKDTLKRRSWPLNEGVMAVGLVSILASSLLRNDVPMAGPLVAGGLLIACYVITGTSADLTVEKAADITWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTYNGKRLEPNWASVKKDLISYGGGWRLSAQWQKGEEVQVIAVEPGKNPKNFQTMPGTFQTITGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKEFAAGRKSIALDLVTEIGRVPSHLAHRTRNALDNLVMLHTSEHGGRAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKDFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVASVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRSMPGTRRIMGITAEWLWRTLGRNKKPRLCTREEFTKKVRTNAAMGAVFTEENQWDSAKAAVEDEDFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPTGTVMDIISRKDQRGSGQVGTYGLNTFTNMEAQLIRQMEGEGVLSKADLENPHLPEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLKETACLGKAYAQMWSLMYFHRRDLRLASNAICSAVPVHWVPTSRTTWSIHAHHQWMTTEDMLTVWNRVWIEDNPWMEDKTPVTTWENVPYLGKREDQWCGSLIGLTSRATWAQNIPTAIQQVRSLIGNEEFLDYMPSMKRFRKEEESEGAIW

SEQ ID NO: 4786 - protein, 3290 aa, Artificial Sequence
  derived and/or modified protein sequence (wt) from DENV-3__JN000938__SS-prME
TSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEATLPEEQDQNYVCKHTYVDRGWGNGCGLFGKGSLVTCAKFQCLEPIEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDVPCKIPFSTEDGQGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSVSRAWNVWEVEDYGFGVFTTNIWLKLREVYTQLCDHRLMSAAVKDERAVHADMGYWIESQKNGSWKLEKASLIEVKTCTWPKSHTLWSNGVLESDMIIPKSLAGPISQHNHRPGYHTQTAGPWHLGKLELDFNYCEGTTVVITENCGTRGPSLRTTTVSGKLIHEWCCRSCTLPPLRYMGEDGCWYGMEIRPFSEKEENMVKSLVSAGGGKVDNFTMGVLCLAILFEEVMRGKFGKKHMIAGVFFTFVLLLSGQITWRDMAHTLIMIGSNASDRMGMGVTYLALIATFKIQPFLALGFFLRKLTSRENLLLGVGLAMATTLQLPEDIEQMANGIALGLMALKLITQFETYQLWTALISLTCSNTIFTLTVAWRTATLILAGVSLLPVCQSSSMRKTDWLPMAVAAMGVPPLPLFIFGLKDTLKRRSWPLNEGVMAVGLVSILASSLLRNDVPMAGPLVAGGLLIACYVITGTSADLTVEKAADITWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTYNGKRLEPNWASVKKDLISYGGGWRLSAQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKEFAAGRKSIALDLVTEIGRVPSHLAHRTRNALDNLVMLHTSEHGGRAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKDFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVASVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRSMPGTRRVMGITAEWLWRTLGRNKKPRLCTREEFTKKVRTNAAMGAVFTEENQWDSAKAAVEDEDFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPTGTVMDIISRKDQRGSGQVGTYGLNTFTNMEAQLIRQMEGEGVLSKADLENPHLPEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLKETACLGKAYAQMWSLMYFHRRDLRLASNAICSAVPVHWVPTSRTTWSIHAHHQWMTTEDMLTVWNRVWIEDNPWMEDKTPVTTWENVPYLGKREDQWCGSLIGLTSRATWAQNIPTAIQQVRSLIGNEEFLDYMPSMKRFRKEEESEGAIW

SEQ ID NO: 4787 - protein, 3290 aa, Artificial Sequence
  derived and/or modified protein sequence (wt) from DENV-3__JN093515__SS-prME
TSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEATLPEEQDQNYVCKHTYVDRGWGNGCGLFGKGSLVTCAKFQCLEPIEGKVVQHENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDVPCKIPFSTEDGQGKAHNGRLITANPVVTKREEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSVSRAWNVWEVEDYGFGVFTTNIWLKLREVYTQLCDHRLMSAAVKDERAVHADMGYWIESQKNGSWKLEKASLIEVKTCTWPKSHTLWSNGVLESDMIIPKSLAGPISQHNHRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGKVDNFTMGVLCLAILFEEVMRGKFGKKHMIAGVFFTFVLLLSGQITWRDMAHTLIMIGSNASDRMGMGVTYLALIATFKIQPFLALGFFLRKLTSRENLLLGVGLAMATTLQLPEDIEQMANGIALGLMALKLITQFEIYQLWTALISLTCSNTIFTLTVAWRTATLILAGVSLLPMCQSSSMRKTDWLPMAVAAMGVPPLPLFIFSLKDTLKRRSWPLNEGVMAVGLVSILASSLLRNDVPMAGPLVAGGLLIACYVITGTSADLTVEKAADITWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTYNGKRLEPNWASVKKDLISYGGGWRLSAQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKEFAAGRKSIALDLVTEIGRVPSHLAHRTRNALDNLVMLHTSEHGGRAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCVVQLLLMRTSWALCEALTLATGPITTLWEGSPGKFWNTTIAVSMANIFRGSYLAGAGLAFSIMKSVGTGKRGTGSQGETLGEKWKKKLNQLSRKDFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVASVNMVSRLLLNRFTMTHRRPTIEKDVDLGAGTRHVNAEPETPNMDIIGERIKRIKEEHNSTWHYDDENPYKTWAYHGSYEVKATGSASSMINGVVKLLTKPWDVVPMVTQMAMTDTTPFGQQRVFKEKVDTRTPRSMPGTRRVMGITAEWLWRTLGRNKKPRLCTREEFTKKVRTNAAMGAVFTEENQWDSAKAAVEDEDFWKLVNRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPTGTVMDIISRKDQRGSGQVGTYGLNTFTNMEAQLIRQMEGEGVLSKADLENPHLPEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLKETACLGKAYAQMWSLMYFHRRDLRLASNAICSAVPVHWVPTSRTTWSIHAHHQWMTTEDMLTVWNRVWIEDNPWMEDKTPVTTWENVPYLGKREDQWCGSLIGLTSRATWAQNIPTAIQQVRSLIGNEEFLDYMPSMKRFRKEEESEGAIW

SEQ ID NO: 4788 - protein, 3290 aa, Artificial Sequence
  derived and/or modified protein sequence (wt) from DENV-3__JF937646__SS-prME
TSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGIGNRDFVEGLSGATWVDVVLEHGGCVTTMAKNKPTLDIELQKTEATQLATLRKLCIEGKITNITTDSRCPTQGEATLPEEQDQNYVCKHTYVDRGWGNGCGLFGKGSLVTCAKFQCLEPIEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNAFVLKKEVSETQHGTILIKVEYKGEDVPCKIPFSTEDGQGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSVSRAWNVWEVEDYGFGVFTTNIWLKLREVYTQLCDHRLMSAAVKDERAVHADMGYWIESQKNGSWKLEKASLIEVKTCTWPKSHTLWSNGVLESDMIIPKSLAGPISQHNHRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGKVDNFTMGVLCLAILFEEVMRGKFGKKHMIAGVFFTFVLLLSGQITWRDMAHTLIMIGSNASDRMGMGVTYLALIATFKIQPFLALGFFLRKLTSRENLLLGVGLAMVTTLQLPEDIEQMANGIALGLMALKLITQFETYQLWTALISLTCSNTIFTLTVAWRTATLILAGVSLLPVCQSSSMRKTDWLPMAVAAMGVPPLPLFIFGLKDTLKRRSWPLNEGVMAVGLVSILASSLLRNDVPMAGPLVAGGLLIACYVITGTSADLTVEKAADITWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTYNGKRLEPNWASVKKDLISYGGGWRLSAQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKVGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKEFAAGRKSIALDLVTEIGRVPSHLAHRTRNALDNLVMLHTSEHGGRAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKDFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVASVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRSMPGTRRVMGITAEWLWRTLGRNKKPRLCTREEFTKKVRTNAAMGAVFTEENQWDSAKAAVEDEDFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPTGTVMDIISRKDQRGSGQVGTYGLNTFTNMEAQLIRQMEGEGVLSKADLENPHLPEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLKETACLGKAYAQMWSLMYFHRRDLRLASNAICSAVPVHWVPTSRTTWSIHAHHQWMTTEDMLTVWNRVWIEDNPWMEDKTPVTTWENVPYLGKREDQWCGSLIGLTSRATWAQNIPTAIQQVRSLIGNEEFLDYMPSMKRFRKEEESEGAIW

SEQ ID NO: 4789 - protein, 3290 aa, Artificial Sequence
  derived and/or modified protein sequence (wt) from DENV-3__JF937633__SS-prME
TSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEATLPEEQDQNYVCKHTYVDRGWGNGCGLFGKGSLVTCAKFQCLEPIEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDVPCKIPFSTEDGQGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSVSRAWNVWEVEDYGFGVFTTNIWLKLREVYTQLCDHRLMSAAVKDERAVHADMGYWIESQKNGSWKLEKASLIEVKTCTWPKSHTLWSNGVLESDMIIPKSLAGPISQHNHRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGKVDNFTMGVLCLAILFEEVMRGKFGKKHMIAGVFFTFVLLLSGQITWRDMAHTLIMIGSNASDRMGMGVTYLALIATFKIQPFLALGFFLRKLTSRENLLLGVGLAMATTLQLPEDIEQMANGIALGLMALKLITQFETYQLWTALISLTCSNTIFTLTVAWRTATLILAGVSLLPVCQSSSMRKTDWLPMAVAAMGVPPLPLFIFGLKDTLKRRSWPLNEGVMAVGLVSILASSLLRNDVPMAGPLVAGGLLIACYVITGTSADLTVEKAADITWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTYNGKRLEPNWASVKKDLISYGGGWRLSAQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKEFAAGRKSITLDLVTEIGRVPSHLAHRTRNALDNLVMLHTSEHGGRAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKDFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVASVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRSMPGTRRVMGITAEWLWRTLGRNKKPRLCTREEFTKKVRTNAAMGAVFTEENQWDSAKAAVEDEDFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPTGTVMDIISRKDQRGSGQVGTYGLNTFTNMEAQLIRQMEGEGVLSKADLENPHLPEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLKETACLGKAYAQMWSLMYFHRRDLRLASNAICSAVPVHWVPTSRTTWSIHAHHQWMTTEDMLTVWNRVWIEDNPWMEDKTPVTTWENVPYLGKREDQWCGSLIGLTSRATWAQNIPTAIQQVRSLIGNEEFLDYMPSMKRFRKEEESEGAIW

SEQ ID NO: 4790 - protein, 3290 aa, Artificial Sequence
  derived and/or modified protein sequence (wt) from DENV-3__JF937634__SS-prME
TSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEATLPEEQDQNYVCKHTYVDRGWGNGCGLFGKGSLVTCAKFQCLEPIEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDVPCKIPFSTEDGQGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQADMGCVINWKGKELKCGSGIFVTNEVHTWTEQYKFQADSPKRLATAIAGAWENGVCGIRSTTRMENLLWKQIVNELNYILWENNIKLTVVVGDIIGVLEQGKRTLTPQPMELKYSWKTWGKAKIVTAETQNSSFIIDGPNTPECPSVSRAWNVWEVEDYGFGVFTTNIWLKLREVYTQLCDHRLMSAAVKDERAVHADMGYWIESQKNGSWKLEKASLIEVKTCTWPKSHTLWSNGVLESDMIIPKSLAGPISQHNHRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGKVDNFTMGVLCLAILFEEVMRGKFGKKHMIAGVFFTFVLLLSGQITWRDMAHTLIMIGSNASDRMGMGVTYLALIATFKIQPFLALGFFLRKLTSRENLLLGVGLAMATTLQLPEDIEQMANGIALGLMALKLITQFETYQLWTALISLTCSNTIFTLTVAWRTATLILAGVSLLPVCQSSSMRKTDWLPMAVAAMGVPPLPLFIFGLKDTLKRRSWPLNEGVMAVGLVSILASSLLRNDVPMAGPLVAGGLLIACYVITGTSADLTVEKAADITWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTYNGKRLEPNWASVKKDLISYGGGWRLSAQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKEFAAGRKSIALDLVTEIGRVPSHLAHRTRNALDNLVMLHTSEHGGRAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKDFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVASVNMVSRLLLNRFTMTHRRPTIEKDVDLGAGTRHVNAEPETPNMEVIGERIKRIKEEHNSTWHYDDENPYKTWAYHGSYEVKATGSASSMINGVVKLLTKPWDVVPMVTQMAMTDTTPFGQQRVFKEKVDTRTPRSMPGTRRVMGITAEWLWRTLGRNKKPRLCTREEFTKKVRTNAAMGAVFTEENQWDSAKAAVEDEDFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLADAIFKLTYQNKVVKVQRPTPTGTVMDIISRKDQRGSGQVGTYGLNTFTNMEAQLIRQMEGEGVLSKADLENPHLPEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLKETACLGKAYAQMWSLMYFHRRDLRLASNAICSAVPVHWVPTSRTTWSIHAHHQWMTTEDMLTVWNRVWIEDNPWMEDKTPVTTWENVPYLGKREDQWCGSLIGLTSRATWAQNIPTAIQQVRSLIGNEEFLDYMPSMKRFRKEEESEGAIW

SEQ ID NO: 4791 - protein, 3290 aa, Artificial Sequence
  derived and/or modified protein sequence (wt) from DENV-3__JF937636__SS-prME
TSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEATLPEEQDQNYVCKHTYVDRGWGNGCGLFGKGSLVTCAKFQCLEPIEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDVPCKIPFSTEDGQGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSVSRAWNVWEVEDYGFGVFTTNIWLKLREVYTQLCDHRLMSAAVKDERAVHADMGYWIESQKNGSWKLEKASLIEVKTCTWPKSHTLWSNGVLESDMIIPKSLAGPISQHNHRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGKVDNFTMGILCLAILFEEVMRGKFGKKHMIAGVFFTFVLLLSGQITWRDMAHTLIMIGSNASDRMGMGVTYLALIATFKIQPFLALGFFLRKLTSRENLLLGVGLAMATTLQLPEDIEQMANGIALGLMALKLITQFETYQLWTALISLTCSNTIFTLTVAWRTATLILAGVSLLPVCQSSSMRKTDWLPMAVAAMGVPPLPLFIFSLKDTLKRRSWPLNEGVMAVGLVSILASSLLRNDVPMAGPLVAGGLLIACYVITGTSADLTVEKAADITWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTYNGKRLEPNWASVKKDLISYGGGWRLSAQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIRRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKEFAAGRKSIALDLVTEIGRVPSHLAHRTRNALDNLVMLHTSEHGGRAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKDFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVASVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRSMPGTRRVMGITAEWLWRTLGRNKKPRLCTREEFTKKVRTNAAMGAVFTEENQWDSAKAAVEDEDFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPTGTVMDIISRKDQRGSGQVGTYGLNTFTNMEAQLIRQMEGEGVLSKADLENPHLPEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLKETACLGKAYAQMWSLMYFHRRDLRLASNAICSAVPVHWVPTSRTTWSIHAHHQWMTTEDMLTVWNRVWIEDNPWMEDKTPVTTWENVPYLGKREDQWCGSLIGLTSRATWAQNIPTAIQQVRSLIGNEEFLDYMPSMKRFRKEEESEGAIW

SEQ ID NO: 4792 - protein, 3290 aa, Artificial Sequence
  derived and/or modified protein sequence (wt) from DENV-3__JF937626__SS-prME
TSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEATLPEEQDQNYVCKHTYVDRGWGNGCGLFGKGSLVTCAKFQCLEPIEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDVPCKIPFSTEDGQGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSVSRAWNVWEVEDYGFGVFTTNIWLKLREVYTQLCDHRLMSAAVKDERAVHADMGYWIESQKNGSWKLEKASLIEVKTCTWPKSHTLWSNGVLESDMIIPKSLAGPISQHNHRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGKVDNFTMGVLCLAILFEEVMRGKFGKKHMIAGVFFTFVLLLSGQITWRDMAHTLIMIGSNASDRMGMGVTYLALIATFKIQPFLALGFFLRKLTSRENLLLGVGLAMATTLQLPEDIEQMANGIALGLMALKLITQFETYQLWTALISLTCSNTIFTLTVAWRTATLILAGVSLLPVCQSSSMRKTDWLPMAVAAMGVPPLPLFIFGLKDTLKRRSWPLNEGVMAVGLVSILASSLLRNDVPMAGPLVAGGLLIACYVITGTSADLTVEKAADMTWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTYNGKRLEPNWASVKKDLISYGGGWRLSAQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKEFAAGRKSIALDLVTEIGRVPSHLAHRTRNALDNLVMLHTSEHGGRAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKDFDLYKKSGITEVDRTEAKEGLKRGEITHHAVSRGSAKLQWFVERNMVVPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVASVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRSMPGTRRVMGITAEWLWRTLGRNKKPRLCTREEFTKKVRTNAAMGAVFTEENQWDSAKAAVEDEDFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPTGTVMDIISRKDQRGSGQVGTYGLNTFTNMEAQLIRQMEGEGVLSKADLENPHLPEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLKETACLGKAYAQMWSLMYFHRRDLRLASNAICSAVPVHWVPTSRTTWSIHAHHQWMTTEDMLTVWNRVWIEDNPWMEDKTPVTTWENVPYLGKREDQWCGSLIGLTSRATWAQNIPTAIQQVRSLIGNEEFLDYMPSMKRFRKEEESEGAIW

SEQ ID NO: 4793 - protein, 3290 aa, Artificial Sequence
  derived and/or modified protein sequence (wt) from DENV-3__JF937621__SS-prME
TSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEATLPEEQDQNYVCKHTYVDRGWGNGCGLFGKGSLVTCAKFQCLEPIEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDVPCKIPFSTEDGQGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSVSRAWNVWEVEDYGFGVFTTNIWLKLREVYTQLCDHRLMSAAVKDERAVHADMGYWIESQKNGSWKLEKASLIEVKTCTWPKSHTLWSNGVLESDMIIPKSLAGPISQHNHRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGKVDNFTMGVLCLAILFEEVMRGKFGKKHMIAGVFFTFVLLLSGQITWRDMAHTLIMIGSNASDRMGMGVTYLALIATFKIQPFLALGFFLRKLTSRENLLLGVGLAMATTLQLPEDIEQMANGIALGLMALKLITQFETYQLWTALISLTCSNTIFTLTVAWRTATLILAGVSLLPVCQSSSMRKTDWLPMAVAAMGVPPLPLFIFGLKDTLKRRSWPLNEGVMAVGLVSILASSLLRNDVPMAGPLVAGGLLIACYVITGTSADLTVERAADITWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTYNGKRLEPNWASVKKDLISYGGGWRLSAQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKEFAAGRKSIALDLVTEIGRVPSHLAHRTRNALDNLVMLHTSEHGGRAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKDFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVASVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRSMPGTRRVMGITAEWLWRTLGRNKKPRLCTREEFTKKVRTNAAMGAVFTEENQWDSAKAAVEDEDFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPTGTVMDIISRKDQRGSGQVGTYGLNTFTNMEAQLIRQMEGEGVLSKADLENPHLPEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLKETACLGKAYAQMWSLMYFHRRDLRLASNAICSAVPVHWVPTSRTTWSIHAHHQWMTTEDMLTVWNRVWIEDNPWMEDKTPVTTWENVPYLGKREDQWCGSLIGLTSRATWAQNIPTAIQQVRSLIGNEEFLDYMPSMKRFRKEEESEGAIW

SEQ ID NO: 4794 - protein, 3290 aa, Artificial Sequence
  derived and/or modified protein sequence (wt) from DENV-3__JF937623__SS-prME
ASLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEATLPEEQDQNYVCKHTYVDRGWGNGCGLFGKGSLVTCAKFQCLEPIEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDVPCKIPFSTEDGQGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSVSRAWNVWEVEDYGFGVFTTNIWLKLREVYTQLCDHRLMSAAVKDERAVHADMGYWIESQKNGSWKLEKASLIEVKTCTWPKSHTLWSNGVLESDMIIPKSLAGPISQHNHRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGKVDNFTMGVLCLAILFEEVMRGKFGKKHMIAGIFFTFVLLLSGQITWRDMAHTLIMIGSNASDRMGMGVTYLALIATFKIQPFLALGFFLRKLTSRENLLLGVGLAMATTLQLPEDIEQMANGIALGLMALKLITQFETYQLWTALISLTCSNTIFTLTVAWRTATLILAGVSLLPVCQSSSMRKTDWLPMAVAAMGVPPLPLFIFGLKDTLKRRSWPLNEGVMAVGLVSILASSLLRNDVPMAGPLVAGGLLIACYVITGTSADLTVEKAADMTWEEEAEQTGVSHNLMITVDDDGTMRIKDDETENILTVLLKTALLIVSGIFPYSIPATLLVWHTWQKQTQRSGVLWDVPSPPETQKAELEEGIYRIKQQGIFGKTQVGVGVQKEGVFHTMWHVTRGAVLTYNGKRLEPNWASVKKDLISYGGGWRLSAQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKEFAAGRKSIALDLVTEIGRVPSHLAHRTRNALDNLVMLHTSEHGGRAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKDFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVASVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRSMPGTRRVMGITAEWLWRTLGRNKKPRLCTREEFTKKVRTNAAMGAVFTEENQWDSAKAAVEDEDFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPTGTVMDIISRKDQRGSGQVGTYGLNTFTNMEAQLIRQMEGEGVLSKADLENPHLPEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLKETACLGKAYAQMWSLMYFHRRDLRLASNAICSAVPVHWVPTSRTTWSIHAHHQWMTTEDMLTVWNRVWIEDNPWMEDKTPVTTWENVPYLGKREDQWCGSLIGLTSRATWAQNIPTAIQQVRSLIGNEEFLDYMPSMKRFRKEEESEGAIW

SEQ ID NO: 4795 - protein, 3290 aa, Artificial Sequence
  derived and/or modified protein sequence (wt) from DENV-3__JF937637__SS-prME
TSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEATLPEEQDQNYVCKHTYVDRGWGNGCGLFGKGSLVTCAKFQCLEPIEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNAFVLKKEVSETQHGTILIKVEYKGEDVPCKIPFSTEDGQGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSVSRAWNVWEVEDYGFGVFTTNIWLKLREVYTQLCDHRLMSAAVKDERAVHADMGYWIESQKNGSWKLEKASLIEVKTCTWPKSHTLWSNGVLESDMIIPKSLAGPISQHNHRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGKVDNFTMGVLCLAILFEEVMRGKFGKKHMIAGVFFTFVLLLSGQITWRDMAHTLIMIGSNASDRMGMGVTYLALIATFKIQPFLALGFFLRKLTSRENLLLGVGLAMATTLQLPEDIEQMANGIALGLMALKLITQFETYQLWTALISLTCSNTIFTLTVAWRTATLILAGVSLLPVCQSSSMRKTDWLPMAVAAMGVPPLPLFIFGLKDTLKRRSWPLNEGVMAVGLVSILASSLLRNDVPMAGPLVAGGLLIACYVITGTSADLTVEKAADITWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTYNGKRLEPNWASVKKDLISYGGGWRLSAQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKEFAAGRKSIALDLVTEIGRVPSHLAHRTRNALDNLVMLHTSEHGGRAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKDFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVASVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRSMPGTRRVMGITAEWLWRTLGRNKKPRLCTREEFTKKVRTNAAMGAVFTEENQWDSAKAAVEDEDFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPTGTVMDIISRKDQRGSGQVGTYGLNTFTNMEAQLIRQMEGEGVLLKADLENPHLPEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLKETACLGKAYAQMWSLMYFHRRDLRLASNAICSAVPVHWVPTSRTTWSIHAHHQWMTTEDMLTVWNRVWIEDNPWMEDKTPVTTWENVPYLGKREDQWCGSLIGLTSRATWAQNIPTAIQQVRSLIGNEEFLDYMPSMKRFRKEEESEGAIW

SEQ ID NO: 4796 - protein, 3290 aa, Artificial Sequence
  derived and/or modified protein sequence (wt) from DENV-3__JF937638__SS-prME
TSLCLLMILPAALAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEATLPEEQDQNYVCKHTYVDRGWGNGCGLFGKGSLVTCAKFQCLEPIEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDVPCKIPFSTEDGQGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSVSRAWNVWEVEDYGFGVFTTNIWLKLREVYTQLCDHRLMSAAVKDERAVHADMGYWIESQKNGSWKLEKASLIEVKTCTWPKSHTLWSNGVLESDMIIPKSLAGPISQHNHRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGKVDNFTMGVLCLAILFEEVMRGKFGKKHMIAGVFFTFVLLLSGQITWRDMAHTLIMIGSNASDRMGMGVTYLALIATFKIQPFLALGFFLRRLTSRENLLLGVGLAMATTLQLPEDIEQMANGIALGLMALKLITQFETYQLWTALISLTCSNTIFTLTVAWRTATLILAGVSLLPVCRSSSMRKTDWLPMAVAAMGVPPLPLFIFSLKDTLKRRSWPLNEGVMAVGLVSILASSLLRNDVPMAGPLVAGGLLIACYVITGTSADLTVEKAADITWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTYNGKRLEPNWASVKKDLISYGGGWRLSAQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKEFAAGRKSIALDLVTEIGRVPSHLAHRTRNALDNLVMLHTSEHGGRAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKRKLNQLSRKDFDLYKKSGITEVDRTEAKEGLKRGEITHHAVSRGSAKLQWFVERNMVTPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVASVNMVSRLLLNRFTMTHRRPTIEKDVDLGAGTRHVNAEPETPNMDVIGERIKRIKEEHNLTWHYDDENPYKTWAYHGSYEVKATGSASSMINGVVKLLTKPWDVVPMVTQMAMTDTTPFGQQRVFKEKVDTRTPRSMPGTRRVMGITAEWLWRTLGRNKKPRLCTREEFTKKVRTNAAMGAVFTEENQWDSAKAAVEDEDFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPTGTVMDIISRKDQRGSGQVGTYGLNTFTNMEAQIIRQMEGEGVLSKADLENPHLPEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLKETACLGKAYAQMWSLMYFHRRDLRLASNAICSAVPVHWVPTSRTTWSIHAHHQWMTTEDMLTVWNRVWIEDNPWMEDKTPVTTWENVPYLGKREDQWCGSLIGLTSRATWAQNIPTAIQQVRSLIGNEEFLDYMPSMKRFRKEEESEGAIW

SEQ ID NO: 4797 - protein, 3290 aa, Artificial Sequence
  derived and/or modified protein sequence (wt) from DENV-3__JF937639__SS-prME
TSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEATLPEEQDQNYVCKHTYVDRGWGNGCGLFGKGSLVTCAKFQCLEPIEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDAPCKIPFSTEDGQGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSRNTSMSFSCIAIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSVSRAWNVWEVEDYGFGVFTTNIWLKLREAYTQLCDHRLMSAAVKDERAVHADMGYWIESQKNGSWKLEKASLIEVKTCTWPKSHTIWSNGVLESDMIIPKSLAGPISQHNHRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGKVDNFTMGVLCLAILFEEVMRGKFGKKHMIAGVFLTFVLLLSGQITWRDMAHTLIMIGSNASDRMGMGVTYLALIATFKIQPFLALGFFLRKLTSRENLLLGVGLAMATTLQLPEDIEQMANGIALGLMALKLITQFETYQLWTALISLTCSNTIFTLTVAWRTATLILAGVSLLPVCQSSSMRKTDWLPMAVAAMGVPPLPLFIFSLKDTLKRRSWPLNEGVMAVGLVSILASSLLRNDVPMAGPLVAGGLLIACYVITGTSADLTVEKAADITWEEEAEQTGVSHNLMITVDDDGTMRIKDDETENILTVLLKTALLIVSGIFPYSIPATLLVWHTWQKQTKRSGVLWDVPSPPETQKAELEEGVYRIKQQGIFGKTQVGVGVQKEGVFHTMWHVTRGAVLTYNGKRLEPNWASVKKDLISYGGGWRLSAQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKEFAAGRKSIALDLVTEIGRVPSHLAHRTRNALDNLVMLHTSEHGGRAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKDFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVASVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRSMPGTRRVMGITAEWLWRTLGRNKKPRLCTREEFTKKVRTNAAMGAVFTEENQWDSAKAAVEDEDFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPTGTVMDIISRKDQRGSGQVGTYGLNTFTNMEAQLIRQMEGEGVLSKADLENPHLPEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLKETACLGKAYAQMWSLMYFHRRDLRLASNAICSAVPVHWVPTSRTTWSIHAHHQWMTTEDMLTVWNRVWIEDNPWMEDKTPVTTWENVPYLGKREDQWCGSLIGLTSRATWAQNIPTAIQQVRSLIGNEEFLDYMPSMKRFRKEEESEGAIW

SEQ ID NO: 4798 - protein, 3290 aa, Artificial Sequence
  derived and/or modified protein sequence (wt) from DENV-3__JF937627__SS-prME
TSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEATLPEEQDQNYVCKHTYVDRGWGNGCGLFGKGSLVTCAKFQCLEPIEGKVVQHENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDVPCKIPFSTEDGQGKAHNGRLITANPVVTKREEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSVSRAWNVWEVEDYGFGVFTTNIWLKLREVYTQLCDHRLMSAAVKDERAVHADMGYWIESQKNGSWKLEKASLIEVKTCTWPKSHTLWSNGVLESDMIIPKSLAGPISQHNHRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGKVDNFTMGVLCLAILFEEVMRGKFGKKHMIAGVFFTFVLLLSGQITWRDMAHTLIMIGSNASDRMGMGVTYLALIATFKIQPFLALGFFLRKLTSRENLLLGVGLAMATTLQLPEDIEQMANGIALGLMALKLITQFEIYQLWTALISLTCSNTIFTLTVAWRTATLILAGVSLLPMCQSSSMRKTDWLPMAVAAMGVPPLPLFIFSLKDTLKRRSWPLNEGVMAVGLVSILASSLLRNDVPMAGPLVAGGLLIACYVITGTSADLTVEKAADITWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTYNGKRLEPNWASVKKDLISYGGGWRLSAQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKEFAAGRKSIALDLVTEIGRVPSHLAHRTRNALDNLVMLHTSEHGGRAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCVVQLLLMRTSWALCEALTLATGPITTLWEGSPGKFWNTTIAVSMANIFRGSYLAGAGLAFSIMKSVGTGKRGTGSQGETLGEKWKKKLNQLSRKDFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVASVNMVSRLLLNRFTMTHRRPTIEKDVDLGAGTRHVNAEPETPNMDIIGERIKRIKEEHNSTWHYDDENPYKTWAYHGSYEVKATGSASSMINGVVKLLTKPWDVVPMVTQMAMTDTTPFGQQRVFKEKVDTRTPRSMPGTRRVMGITAEWLWRTLGRNKKPRLCTREEFTKKVRTNAAMGAVFTEENQWDSAKAAVEDEDFWKLVNKERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPTGTVMDIISRKDQRGSGQVGTYGLNTFTNMEAQLIRQMEGEGVLSKADLENPHLPEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLKETACLGKAYAQMWSLMYFHRRDLRLASNAICSAVPVHWVPTSRTTWSIHAHHQWMTTEDMLTVWNRVWIEDNPWMEDKTPVTTWENVPYLGKREDQWCGSLIGLTSRATWAQNIPTAIQQVRSLIGNEEFLDYMPSMKRFRKEEESEGAIW

SEQ ID NO: 4799 - protein, 3290 aa, Artificial Sequence
  derived and/or modified protein sequence (wt) from DENV-3__KF973476__SS-prME
TSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEATLPEEQDQNYVCKHTYVDRGWGNGCGLFGKGSLVTCAKFQCLEPIEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDVPCKIPFSTEDGQGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSVSRAWNVWEVEDYGFGVFTTNIWLKLREVYTQLCDHRLMSAAVKDERAVHADMGYWIESQKNGSWKLEKASLIEVKTCTWPKSHTLWSNGVLESDMIIPKSLAGPISQHNHRPGYHTQTAGPWHLGKLELDFNYCEGTTVVITENCGTRGPSLRTTTVSGKLIHEWCCRSCTLPPLRYIGEDGCWYGMEIRPISEKEENMVKSLVSAGSGKVDNFTMGVLCLAILFEEVMRGKFGKKHMIAGVFFTFVLLLSGQITWRDMAHTLIMIGSNASDRMGMGVTYLALIATFKIQPFLALGFFLRRLTSRENLLLGVGLAMATTLQLPEDIEQMANGIALGLMALKLITQFETYQLWTALISLTCSNTIFTLTVAWRTATLILAGVSLLPVCQSSSMRKTDWLPMAVAAMGVPPLPLFIFSLKDTLKRRSWPLNEGVMAVGLVSILASSLLRNDVPMAGPLVAGGLLIACYVITGTSADLTVEKAADITWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTYNGKRLEPNWASVKKDLISYGGGWRLSAQWQKGEEVQVIAVEPGKNPKNFQTMPGTFQTTTGEIGAIALDFKPGTSGSPIINRGGKVVGLYGNGVVTKNGGYVSGIAQTNAEPDGPTPELEEEMFKKRNLTIMDLHPGSGKTRKYLPAIVREAITRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAVDGEYRLKGESRKTFVELMRRGDLPVWLAHKVASEGIKYTDRKWCFDGQRNNQILEENMDVEIWTKEGEKKKLRPRWLDARTYSDPLALKEFKEFAAGRKSIALDLVTEIGRVPSHLAHRTRNALDNLVMLHTSEHGGRAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKRKLNQLSRKDFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVASVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRSMPGTRRVMGITAEWLWRTLGRNKKPRLCTREEFTKKVRTNAAMGAVFTEENQWDSAKAAVEDEDFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPTGTVMDIISRKDQRGSGQVGTYGLNTFTNMEAQLIRQMEGEGVLSKADLENPYLPEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLKETACLGKAYAQMWSLMYFHRRDLRLASNAICSAVPVHWVPTSRTTWSIHAHHQWMTTEDMLTVWNRVWIEDNPWMEDKTPVTTWENVPYLGKREDQWCGSLIGLTSRATWAQNIPTAIQQVRSLIGNEEFLDYMPSMKRFRKEEESEGAIW

SEQ ID NO: 4800 - protein, 3290 aa, Artificial Sequence
  derived and/or modified protein sequence (wt) from DENV-3__KF973478__SS-prME
TSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEATLPEEQDQNYVCKHTYVDRGWGNGCGLFGKGSLVTCAKFQCLEPIEGKVVQHENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDVPCKIPFSTEDGQGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTSQPMELKYSWKTWGKAKIVTAETQNSSFIIDGPNTPECPSVSRAWNVWEVEDYGFGVFTTNIWLKLREVYTQLCDHRLMSAAVKDERAVHADMGYWIESQKNGSWKLEKASLIEVKTCTWPKSHTLWSNGVLESDMIIPKSLAGPISQHNHRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGKVDNFTMGVLCLAILFEEVMRGKFGKKHMIAGVFFTFVLLLSGQITWRDMAHTLIMIGSNASDRMGMGVTYLALIATFKIQPFLALGFFLRKLTSRENLLLGVGLAMATTLQLPEDIEQMANGIALGLMALKLITQFETYQLWTALISLTCSNTIFTLTVAWRTATLILAGVSLLPVCQSSSMRKTDWLPMAVAAMGVPPLPLFIFGLKDTLKRRSWPLNEGVMAVGLVSILASSLLRNDVPMAGPLVAGGLLIACYVITGTSADLTVEKAADITWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTYNGKRLEPNWASVKKDLISYGGGWRLSAQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKEFAAGRKSIALDLVTEIGRVPSHLAHRTRNALDNLVMLHTSEHGGRAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKDFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVASVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRSMPGTRRVMGITAEWLWRTLGRNKKPRLCTREEFTKKVRTNAAMGAVFTEENQWDSAKAAVEDEDFWKLVDRERELHKLGKCGSCVYNMMGKREKKLGEFGKAKGSRAIWYMWLGARYLEFEALGFLNEDHWFSRENSYSGVEGEGLHRLGYILRDISKIPGGAMYADDTAGWDTRITEDDLHNEEKITQQMDPEHRQLANAIFKLTYQNKVVKVQRPTPTGTVMDIISRKDQRGSGQVGTYGLNTFTNMEAQLIRQMEGEGVLSKADLENPHLPEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLKETACLGKAYAQMWSLMYFHRRDLRLASNAICSAVPVHWVPTSRTTWSIHAHHQWMTTEDMLTVWNRVWIEDNPWMEDKTPVTTWENVPYLGKREDQWCGSLIGLTSRATWAQNIPTAIQQVRSLIGNEEFLDYMPSMKRFRKEEESEGAIW

SEQ ID NO: 4801 - protein, 3290 aa, Artificial Sequence
  derived and/or modified protein sequence (wt) from DENV-3__KF973479__SS-prME
TSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEATLPEEQDQNYVCKHTYVDRGWGNGCGLFGKGSLVTCAKFQCLEPIEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNLGGTSIFAGHLKCRLKMDKLELKGMSYAMCTNTFVLKKEVSETQHGTILIKVEYKGEDAPCKIPFSTEDGQGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSVSRAWNVWEVEDYGFGVFTTNIWLKLREVYTQLCDHRLMSAAVKDERAVHADMGYWIESQKNGSWKLEKASLIEVKTCTWPKSHTLWSNGVLESDMIIPKSLAGPISQHNHRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGKVDNFTMGVLCLAILFEEVMRGKFGKKHMIAGVFFTFVLLLSGQITWRDMAHTLIMIGSSASDRMGMGVTYLALIATFKIQPFLALGFFLRKLTSRENLLLGVGLAMATTLQLPEDIEQMANGIALGLMALKLITQFETYQLWTALISLTCSNTIFTLTVAWRTATLILAGVSLLPVCQSSSMRKTDWLPMAVAAMGVPPLPLFIFGLKDTLKRRSWPLNEGVMAVGLVSILASSLLRNDVPMAGPLVAGGLLIACYVITGTSADLTVEKAADITWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTYNGKRLEPNWASVKKDLISYGGGWRLSAQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKEFAAGRKSIALDLVTEIGRVPSHLAHRTRNALDNLVMLHTSEHGGRAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKDFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVASVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRSMPGTRRVMGITAEWLWRTLGRNKKPRLCTREEFTKKVRTNAAMGAVFTEENQWDSAKAAVEDEDFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPTGTVMDIISRKDQRGSGQVGTYGLNTFTNMEAQLIRQMEGEGVLSKADLENPHLPEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLKETACLGKAYAQMWSLMYFHRRDLRLASNAICSAVPVHWVPTSRTTWSIHAHHQWMTTEDMLTVWNRVWIEDNPWMEDKTPVTTWENVPYLGKREDQWCGSLIGLTSRATWAQNIPTAIQQVRSLIGNEEFLDYMPSMKRFRKEEESEGAIW

SEQ ID NO: 4802 - protein, 3290 aa, Artificial Sequence
  derived and/or modified protein sequence (wt) from DENV-3__KF973480__SS-prME
TSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFTLLMLVTPSMTMRCVGVGNRDFVEGLSGATWVDVVLEHGGCVTTMAKNKPTLDIELQKTEATQLATLRKLCIEGKITNITTDSRCPTQGEATLPEEQDQNYVCKHTYVDRGWGNGCGLFGKGSLVTCAKFQCLEPIEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDVPCKIPFSTEDGQGKAHNGRLITANPVVTKKEEPVNIEAEPPFGESNIVIGIGDNALKINWYKKGSSIGKIFEATARGARRMAILGDTAWDFGSVGGVLNSLGKMVHQIFGSAYTALFSGVSWVMKIGIGVLLTWIGLNSKNTSMSFSCIAIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSVSRAWNVWEVEDYGFGVFTTNIWLKLREVYTQLCDHRLMSAAVKDERAVHADMGYWIESQKNGSWKLEKASLIEVKTCTWPKSHTLWSNGVLESDMIIPKSLAGPISQHNHRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGKVDNFTMGVLCLAILFEEVMRGKFGKKHMIAGVFFTFALLLSGQITWRDMAHTLIMIGSNASDRMGMGVTYLALIATFKIQPFLALGFFLRKLTSRENLLLGVGLAMATTLQLPEDIEQMANGIALGLMALKLITQFETYQLWTALISLTCSNTIFTLTVAWRTATLILAGVSLLPVCQSSSMRKTDWLPMAVAAMGVPPLPLFIFGLKDTLKRRSWPLNEGVMAVGLVSILASSLLRNDVPMAGPLVAGGLLIACYVITGTSADLTVEKAADITWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTYNGKRLEPNWASVKKDLISYGGGWRLSAQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKEFAAGRKSIALDLVTEIGRVPSHLAHRTRNALDNLVMLHTSEHGGRAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKDFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVASVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRSMPGTRRVMGITAEWLWRTLGRNKKPRLCTREEFTKKVRTNAAMGAVFTEENQWDSAKAAVEDEDFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPTGTVMDIISRKDQRGSGQVGTYGLNTFTNMEAQLIRQMEGEGVLSKADLENPHLPEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLKETACLGKAYAQMWSLMYFHRRDLRLASNAICSAVPVHWVPTSRTTWSIHAHHQWMTTEDMLTVWNRVWIEDNPWMEDKTPVTTWENVPYLGKREDQWCGSLIGLTSRATWAQNIPTAIQQVRSLIGNEEFLDYMPSMKRFRKEEESEGAIW

SEQ ID NO: 4803 - protein, 3290 aa, Artificial Sequence
  derived and/or modified protein sequence (wt) from DENV-3__KF973481__SS-prME
TSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEATLPEEQDQNYVCKHTYVDRGWGNGCGLFGKGSLVTCAKFQCLEPIEGKVVQYENLKYTIIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDVPCKIPFSTEDGQGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSVSRAWNVWEVEDYGFGVFTTNIWLKLREVYTQLCDHRLMSAAVKDERAVHADMGYWIESQKNGSWKLEKASLIEVKTCTWPKSHTLWSNGVLESDMIIPKSLAGPISQHNHRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGKVDNFTVGVLCLAILFEEVMRGKFGKKHMIAGVFFTFVLLLSGQITWRDMAHTLIMIGSNASDRMGMGVTYLALIATFKIQPFLALGFFLRKLTSRENLLLGVGLAMATTLQLPEDIEQMANGIALGLMALKLITQFETYQLWTALISLTCSNTIFTLTVAWRTATLILAGVSLLPVCQSSSMRKTDWLPMAVAAMGVPPLPLFIFGLKDTLKRRSWPLNEGVMAVGLVSILASSLLRNDVPMAGPLVAGGLLIACYVITGTSADLTVEKAADITWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTYNGKRLEPNWASVKKDLISYGGGWRLSAQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKEFAAGRKSIALDLVTEIGRVPSHLAHRTRNALDNLVMLHTSEHGGRAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKDFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVASVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRSMPGTRRVMGITAEWLWRTLGRNKKPRLCTREEFTKKVRTNAAMGAVFTEENQWDSAKAAVEDEDFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPTGTVMDIISRKDQRGSGQVGTYGLNTFTNMEAQLIRQMEGEGVLSKADLENPHLPEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLKETACLGKAYAQMWSLMYFHRRDLRLASNAICSAVPVHWVPTSRTTWSIHAHHQWMTTEDMLTVWNRVWIEDNPWMEDKTPVTTWENVPYLGKREDQWCGSLIGLTSRATWAQNIPTAIQQVRSLIGNEEFLDYMPSMKRFRKEEESEGAIW

SEQ ID NO: 4804 - protein, 3290 aa, Artificial Sequence
  derived and/or modified protein sequence (wt) from DENV-3__KF973482__SS-prME
TSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEATLPEEQDQNYVCKHTYVDRGWGNGCGLFGKGSLVTCAKFQCLEPIEGKVVQYENLKYTIIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDVPCKIPFSTEDGQGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSVSRAWNVWEVEDYGFGVFTTNIWLKLREVYTQLCDHRLMSAAVKDERAVHADMGYWIESQKNGSWKLEKASLIEVKTCTWPKSHTLWSNGVLESDMIIPKSLAGPISQHNHRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGKVDNFTVGVLCLAILFEEVMRGKFGKKHMIAGVFFTFVLLLSGQITWRDMAHTLIMIGSNASDRMGMGVTYLALIATFKIQPFLALGFFLRKLTSRENLLLGVGLAMATTLQLPEDIEQMANGIALGLMALKLITQFETYQLWTALISLTCSNTIFTLTVAWRTATLILAGVSLLPVCQSSSMRKTDWLPMAVAAMGVPPLPLFIFGLKDTLKRRSWPLNEGVMAVGLVSILASSLLRNDVPMAGPLVAGGLLIACYVITGTSADLTVEKAADITWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTYNGKRLEPNWASVKKDLISYGGGWRLSAQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKEFAAGRKSIALDLVTEIGRVPSHLAHRTRNALDNLVMLHTSEHGGRAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKDFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVASVNMVSRLLLNRFTMTHRRPTIEKDVDLGAGTRHVNAEPETPNMDVIGERIKRIKEEHNSTWHYDDENPYKTWAYHGSYEVKATGSASSMTNGVVKLLTKPWDVVPMVTQMAMTDTTPFGQQRVFKEKVDTRTPRSMPGTRRVMGITAEWLWRTLGRNKKPRLCTREEFTKKVRTNAAMGAVFTEENQWDSAKAAVEDEDFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPTGTVMDIISRKDQRGSGQVGTYGLNTFTNMEAQLIRQMEGEGVLSKADLENPHLPEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLKETACLGKAYAQMWSLMYFHRRDLRLASNAICSAVPVHWVPTSRTTWSIHAHHQWMTTEDMLTVWNRVWIEDNPWMEDKTPVTTWENVPYLGKREDQWCGSLIGLTSRATWAQNIPTAIQQVRSLIGNEEFLDYMPSMKRFRKEEESEGAIW

SEQ ID NO: 4805 - protein, 3290 aa, Artificial Sequence
  derived and/or modified protein sequence (wt) from DENV-3__KF973483__SS-prME
TSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEATLPEEQDQNYVCKHTYVDRGWGNGCGLFGKGSLVTCAKFQCLEPIEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDAPCKIPFSTEDGQGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSRNTSMSFSCIAIGIITLYLGAVVQADMGCVINWKGKELKCGSGIFVTNEVHTWTEQYKFQADSPKRLATAIVGAWENGVCGIRSTTRMENLLWKQIANELNYILWENNIKLTVVVGDIIGVLEQGKRTLTPQPMELKYSWKTWGKAKIVTAETQNSSFIIDGPNTPECPSVSRAWNVWEVEDYGFGVFTTNIWLKLRETYTQLCDHRLMSAAVKDERAVHADMGYWIESQKNGSWKLEKASLIEVKTCTWPKSHTIWSNGVLESDMIIPKSLAGPISQHNHRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGKVDNFTMGVLCLAILFEEVMRGKFGKKHMIAGVFLTFVLLLSGQITWRDMAHTLIMIGSNASDRMGMGVTYLALIATFKIQPFLALGFFLRKLTSRENLLLGVGLAMATTLQLPEDIEQMANGIALGLMALKLITQFETYQLWTALISLTCSNTIFTLTVAWRTATLILAGVSLLPVCQSSSMRKTDWLPMAVAAMGVPPLPLFIFSLKDTLKRRSWPLNEGVMAVGLVSILASSLLRNDVPMAGPLVAGGLLIACYVITGTSADLTVEKAADITWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTYNGKRLEPNWASVKKDLISYGGGWRLSAQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKEFAAGRKSIALDLVTEIGRVPSHLAHRTRNALDNLVMLHTSEHGGRAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKDFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVASVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRSMPGTRRVMGITAEWLWRTLGRNKKPRLCTREEFTKKVRTNAAMGAVFTEENQWDSAKAAVEDEDFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPTGTVMDIISRKDQRGSGQVGTYGLNTFTNMEAQLIRQMEGEGVLSKADLENPHLPEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLKETACLGKAYAQMWSLMYFHRRDLRLASNAICSAVPVHWVPTSRTTWSIHAHHQWMTTEDMLTVWNRVWIEDNPWMEDKTPVTTWENVPYLGKREDQWCGSLIGLTSRATWAQNIPTAIQQVRSLIGNEEFLDYMPSMKRFRKEEESEGAIW

SEQ ID NO: 4806 - protein, 3290 aa, Artificial Sequence
  derived and/or modified protein sequence (wt) from DENV-3__KF973485__SS-prME
TSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEATLPEEQDQNYVCKHTYVDRGWGNGCGLFGKGSLVTCAKFQCLEPIEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTETPTWNKKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDVPCKIPFSTEDGQGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSVSRAWNVWEVEDYGFGVFTTNIWLKLREVHTQLCDHRLMSAAVKDERAVHADMGYWIESQKNGSWKLEKASLIEVKTCTWPKSHTLWSNGVLESDMIIPKSLAGPISQHNHRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGKVDNFTMGVLCLAILFEEVMRGKFGKKHMIAGVFFTFVLLLSGQITWRDMAHTLIMIGSNASDRMGMGVTYLALIATFKIQPFLALGFFLRKLTSRENLLLGVGLAMATTLQLPEDIEQMANGIALGLMALKLITQFETYQLWTALISLTCSNTIFTLTVAWRTATLILAGVSLLPVCQSSSMRKTDWLPMAVAAMGVPPLPLFIFGLKDTLKRRSWPLNEGVMAVGLVSILASSLLRNDVPMAGPLVAGGLLIACYVITGTSADLTVEKAADITWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTYNGKRLEPNWASVKKDLISYGGGWRLSAQWKKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTVASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKEFAAGRKSIALDLVTEIGRVPSHLAHRTRNALDNLVMLHTSEHGGRAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCVVQLLLMRTSWALCEALTLATGPITTLWEGSPGKFWNTTIAVSMANIFRGSYLAGAGLAFSIMKSVGTGKRGTGSQGETLGEKWKKKLNQLSRKDFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVASVNMVSRLLLNRFTMTHRRPTIEKDVDLGAGTRHVNAEPETPNMEVIGERIKRIKEEHNSTWHYDDENPYKTWAYHGSYEVKATGSASSMINGVVKLLTKPWDMVPMVTQMAMTDTTPFGQQRVFKEKVDTRTPRSMPGTRRVMGITAEWLWRTLGRNKKPRLCTREEFTKKVRTNAAMGAVFTEENQWDSAKAAVEDEDFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLADAIFKLTYQNKVVKVQRPTPTGTVMDIISRKDQRGSGQVGTYGLNTFTNMEAQLIRQMEGEGVLSKADLENPHLPEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLKETACLGKAYAQMWSLMYFHRRDLRLASNAICSAVPVHWVPTSRTTWSIHAHHQWMTTEDMLTVWNRVWIEDNPWMEDKTPVTTWENVPYLGKREDQWCGSLIGLTSRATWAQNIPTAIQQVRSLIGNEEFLDYMPSMKRFRKEEESEGAIW

SEQ ID NO: 4807 - protein, 3290 aa, Artificial Sequence
  derived and/or modified protein sequence (wt) from DENV-3__KF973486__SS-prME
TSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEATLPEEQDQNYVCKHTYVDRGWGNGCGLFGKGSLVTCAKFQCLEPIEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDVPCKIPFSTEDGQGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSVSRAWNVWEVEDYGFGVFTTNIWLKLREVYTQLCDHRLMSAAVKDERAVHADMGYWIESQKNGSWKLEKASLIEVKTCTWPKSHTLWSNGVLESDMIIPKSLAGPISQHNHRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGKVDNFTMGVLCLAILFEEVMRGKFGKKHMIAGVFFTFVLLLSGQITWRDMAHTLIMIGSNASDRMGMGVTYLALIATFKIQPFLALGFFLRKLTSRENLLLGVGLAMATTLQLPEDIEQMANGIALGLMALKLITQFETYQLWTALISLTCSNTIFTLTVAWRTATLILAGVSLLPVCQSSSMRKTDWLPMAVAAMGVPPLPLFIFGLKDTLKRRSWPLNEGVMAVGLVSILASSLLRNDVPMAGPLVAGGLLIACYVITGTSADLTVEKAADITWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTYNGKRLEPNWASVKKDLISYGGGWRLSAQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKEFAAGRKSIALDLVTEIGRVPSHLAHRTRNALDNLVMLHTSEHGGRAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGAPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKDFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVASVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRSMPGTRRVMGITAEWLWRTLGRNKKPRLCTREEFTKKVRTNAAMGAVFTEENQWDSAKAAVEDEDFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPTGTVMDIISRKDQRGSGQVGTYGLNTFTNMEAQLIRQMEGEGVLSKADLENPHLPEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLKETACLGKAYAQMWSLMYFHRRDLRLASNAICSAVPVHWVPTSRTTWSIHAHHQWMTTEDMLTVWNRVWIEDNPWMEDKTPVTTWENVPYLGKREDQWCGSLIGLTSRATWAQNIPTAIQQVRSLIGNEEFLDYMPSMKRFRKEEESEGAIW

SEQ ID NO: 4808 - protein, 3290 aa, Artificial Sequence
  derived and/or modified protein sequence (wt) from DENV-3__FJ898458__SS-prME
TSLCLMMILPAALAFHLTSRDGEPRMIVGKNERGKTLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAVLPEEQDQNYVCKHTYVDRGWGNGCGLFGKGSLVTCAKFQCLEPIEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDVPCKIPFSTEDGHGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSASRAWNVWEVEDYGFGVFTTNIWLKLREVYTQLCDHRLMSAAVKDERAVHADMGYWIESQKNGSWKLEKASLIEVKTCTWPKSHTLWSNGVLESDMIIPKSLAGPISQHNHRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGKVDNFTMGVLCLAILFEEVMRGKFGKKHMIAGVFFTFVLLLSGQITWRDMAHTLIMIGSNASDRMGMGVTYLALIATFKIQPFLALGFFLRKLTSRENLLLGVGLAMATTLQLPEDIEQMANGIALGLMALKLITQFETYQLWTALISLTCSNTIFTLTVAWRTATLILAGVSLLPVCQSSSMRKTDWLPMTVAAMGVPPLPLFIFSLKDTLKRRSWPLNEGVMAVGLVSILASSLLRNDVPMAGPLVAGGLLIACYVITGTSADLTVEKAADITWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTYNGKRLEPNWASVKKDLISYGGGWRLSAQWKKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKDFAAGRKSIALDLVTEIGRVPSHLAHRTRNALDNLVMLHTSEHGGRAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVASVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRSMPGTRRVMGITAEWLWRTLGRNKKPRLCTREEFTKKVRTNAAMGAVFTEENQWDSAKAAVEDEDFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPTGTVMDIISRKDQRGSGQVGTYGLNTFTNMEAQLIRQMEGEGVLSKADLENPHLPEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLRETACLGKAYAQMWSLMYFHRRDLRLASNAICSAVPVHWVPTSRTTWSIHAHHQWMTTEDMLTVWNRVWIEDNPWMEDKTPVTTWENVPYLGKREDQWCGSLIGLTSRATWAQNIPTAIQQVRSLIGNEEFLDYMPSMKRFRKEEESEGAIW

SEQ ID NO: 4809 - protein, 3290 aa, Artificial Sequence
  derived and/or modified protein sequence (wt) from DENV-3__KJ189256__SS-prME
TSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAVLPEEQDQNYVCKHTYVDRGWGNGCGLFGKGSLVTCAKFQCLEPIEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDVPCKIPFSTEDGHGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSASRAWNVWEVEDYGFGVFTTNIWLKLREVYTQLCDHRLMSAAVKDERAVHADMGYWIESQKNGSWKLEKASLIEVKTCTWPKSHTLWSNGVLESDMIIPKSLAGPISQHNHRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGKVDNFTMGVLCLAILFEEVMRGKFGKKHMIAGVFFTFVLLLSGQITWRDMAHTLIMIGSNASDRMGMGVTYLALIATFKIQPFLALGFFLRKLTSRENLLLGVGLAMATTLQLPEDIEQMANGIALGLMALKLITQFETYQLWTALISLTCSNTIFTLTVAWRTATLILAGVSLLPVCQSSSMRKTDWLPMAVAAMGVPPLPLFIFSLKDTLKRRSWPLNEGVMAVGLVSILASSLLRNDVPMAGPLVAGGLLIACYVITGTSADLTVEKAADITWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTYNGKRLEPNWASVKKDLISYGGGWRLSAQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKDFAAGRKSIALDLVTEIGRVPSHLAHRTRNALDNLVMLHTSEHGGRAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVASVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRSMPGTRRVMGITAEWLWRTLGRNKKPRLCTREEFTKKVRTNAAMGAVFTEENQWDSAKAAVEDEDFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPTGTVMDIISRKDQRGSGQVGTYGLNTFTNMEAQLIRQMEGEGVLSKADLENPHLPEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLRETACLGKAYAQMWSLMYFHRRDLRLASNAICSAVPVHWVPTSRTTWSIHAHHQWMTTEDMLTVWNRVWIEDNPWMEDKTPVTTWENVPYLGKREDQWCGSLIGLTSRATWAQNIPTAIQQVRSLIGNEEFLDYMPSMKRFRKEEESEGAIW

SEQ ID NO: 4810 - protein, 3290 aa, Artificial Sequence
  derived and/or modified protein sequence (wt) from DENV-3__KJ189257__SS-prME
TSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAVLPEEQDQNYVCKHTYVDRGWGNGCGLFGKGSLVTCAKFQCLEPIEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDVPCKIPFSTEDGHGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSASRAWNVWEVEDYGFGVFTTNIWLKLREVYTQLCDHRLMSAAVKDERAVHADMGYWIESQKNGSWKLEKASLIEVKTCTWPKSHTLWSNGVLESDMIIPKSLAGPISQHNHRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGKVDNFTMGVLCLAILFEEVMRGKFGKKHMIAGVFFTFVLLLSGQITWRDMAHTLIMIGSNTSDRMGMGVTYLALIATFKIQPFLALGFFLRKLTSRENLLLGVGLAMATTLQLPEDIEQMANGIALGLMALKLITQFETYQLWTALISLTCSNTIFTLTVAWRTATLILAGVSLLPVCQSSSMRKTDWLPMAVAAMGVPPLPLFIFSLKDTLKRRSWPLNEGVMAVGLVSILASSLLRNDVPMAGPLVAGGLLIACYVITGTSADLTVEKAADITWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTYNGKRLEPNWASVKKDLISYGGGWRLSAQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKDFAAGRKSIALDLVTEIGRVPSHLAHRTRNALDNLVMLHTSEHGGRAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVFLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVASVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRSMPGTRRVMGITAEWLWRTLGRNKKPRLCTREEFTKKVRTNAAMGAVFTEENQWDSAKAAVEDEDFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPTGTVMDIISRKDQRGSGQVGTYGLNTFTNMEAQLIRQMEGEGVLSKADLENPHLPEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLRETACLGKAYAQMWSLMYFHRRDLRLASNAICSAVPVHWVPTSRTTWSIHAHHQWMTTEDMLTVWNRVWIEDNPWMEDKTPVTTWENVPYLGKREDQWCGSLIGLTSRATWAQNIPTAIQQVRSLIGNEEFLDYMPSMKRFRKEEESEGAIW

SEQ ID NO: 4811 - protein, 3290 aa, Artificial Sequence
  derived and/or modified protein sequence (wt) from DENV-3__KJ189262__SS-prME
TSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAVLPEEQDQNYVCKHTYVDRGWGNGCGLFGKGSLVTCAKFQCLEPIEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDVPCKIPFSTEDGHGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSASRAWNVWEVEDYGFGVFTTNIWLKLREVYTQLCDHRLMSAAVKDERAVHADMGYWIESQKNGSWKLEKASLIEVKTCTWPKSHTLWSNGVLESDMIIPKSLAGPISQHNHRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGKVDNFTMGVLCLAILFEEVMRGKFGKKHMIAGVFFTFVLLLSGQITWRDMAHTLIMIGSNASDRMGMGVTYLALIATFKIQPFLALGFFLRKLTSRENLLLGVGLAMATTLQLPEDIEQMANGIALGLMALKLITQFETYQLWTALISLTCSNTIFTLTVAWRTATLILAGVSLLPVCQSSSMRKTDWLPMAVAAMGVPPLPLFIFSLKDTLKRRSWPLNEGVMAVGLVSILASSLLRNDVPMAGPLVAGGLLIACYVITGTSADLTVEKAADITWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTYNGKRLEPNWASVKKDLISYGGGWRLSAQWQKGEEVQVIAIEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKDFAAGRKSIALDLVTEIGRVPSHLAHRTRNALDNLVMLHTSEHGGRAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVASVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRSMPGTRRVMGITAEWLWRTLGRNKKPRLCTREEFTKKVRTNAAMGAVFTEENQWDSAKAAVEDEDFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPTGTVMDIISRKDQRGSGQVGTYGLNTFTNMEAQLIRQMEGEGVLSKADLENPHLPEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLRETACLGKAYAQMWSLMYFHRRDLRLASNAICSAVPVHWVPTSRTTWSIHAHHQWMTTEDMLTVWNRVWIEDNPWMEDKTPVTTWENVPYLGKREDQWCGSLIGLTSRATWAQNIPTAIQQVRSLIGNEEFLDYMPSMKRFRKEEESEGAIW

SEQ ID NO: 4812 - protein, 3290 aa, Artificial Sequence
  derived and/or modified protein sequence (wt) from DENV-3__KJ189263__SS-prME
TSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAVLPEEQDQNYVCKHTYVDRGWGNGCGLFGKGSLVTCAKFQCLEPIEGKVVQYENLKYTVIITVHTGDQHQVGNETQGVTAEITPQASTTEATLPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTVLIKVEYKGEDVPCKIPFSTEDGHGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSASRAWNVWEVEDYGFGVFTTNIWLRLREVYTQLCDHRLMSAAVKDERAVHADMGYWIESQKNGSWKLEKASLIEVKTCTWPKSHTLWSNGVLESDMIIPKSLAGPISQHNHRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGKVDNFTMGVLCLAILFEEVMRGKFGKKHMIAGVFFTFVLLLSGQITWRDMAHTLIMIGSNASDRMGMGVTYLALIATFKIQPFLALGFFLRKLTSRENLLLGVGLAMATTLQLPEDIEQMANGIALGLMALKLITQFEIYQLWTALISLTCSNTIFTLTVAWRTATLILAGVSLLPVCQSSSMRKTDWLPMAVAAMGVPPLPLFIFSLKDTLKRRSWPLNEGVMAVGLVSILASSLLRNDVPMAGPLVAGGLLIACYVITGTSADLTVEKAADITWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTYNGKRLEPNWASVKKDLISYGGGWRLSTQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKDFAAGRKSIALDLVTEIGRVPSHLAHRTRNALDNLVMLHTSEHGGRAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVASVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRSMPGTRRVMGITAEWLWRTLGRNKKPRLCTREEFTKKVRTNAAMGAVFTEENQWDSAKAAVEDEDFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPTGTVMDIISRKDQRGSGQVGTYGLNTFTNMEAQLIRQMEGEGVLSKADLENPHLPEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLRETACLGKAYAQMWSLMYFHRRDLRLASNAICSAVPVHWVPTSRTTWSIHAHHQWMTTEDMLTVWNRVWIEDNPWMEDKTPVTTWENVPYLGKREDQWCGSLIGLTSRATWAQNIPTAIQQVRSLIGNEEFLDYMPSMKRFRKEEESEGAIW

SEQ ID NO: 4813 - protein, 3290 aa, Artificial Sequence
  derived and/or modified protein sequence (wt) from DENV-3__KJ189265__SS-prME
TSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAVLPEEQDQNYVCKHTYVDRGWGNGCGLFGKGSLVTCAKFQCLEPIEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDVPCKIPFSTEDGHGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDIIGVLEHGKRTLTPQPMELKYSWKTWGKAKIVTAETQNSSFIIDGPNTPECPSASRAWNVWEVEDYGFGVFTTNIWLKLREVYTQLCDHRLMSAAVKDERAVHADMGYWIESQKNGSWKLEKASLIEVKTCTWPKSHTLWSNGVLESDMIIPKSLAGPISQHNHRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGKVDNFTMGVLCLAILFEEVMRGKFGKKHMIAGVFFTFVLLLSGQITWRDMAHTLIMIGSNTSDRMGMGVTYLALIATFKIQPFLALGFFLRKLTSRENLLLGVGLAMATTLQLPEDIEQMANGIALGLMALKLITQFETYQLWTALISLTCSNTIFTLTVAWRTATLILAGVSLLPVCQSSSMRKTDWLPMAVAAMGVPPLPLFIFSLKDTLKRRSWPLNEGVMAVGLVSILASSLLRNDVPMAGPLVAGGLLIACYVITGTSADLTVEKAANITWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTYNGKRLEPNWASVKKDLISYGGGWRLSAQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKDFAAGRKSIALDLVTEIGRVPSHLAHRTRNALDNLVMLHTSEHGGRAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVASVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRSMPGTRRVMGITAEWLWRTLGRNKKPRLCTREEFTKKVRTNAAMGAVFTEENQWDSAKAAVEDEDFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPTGTVMDIISRKDQRGSGQVGTYGLNTFTNMEAQLIRQMEGEGVLSKADLENPHLPEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLRETACLGKAYAQMWSLMYFHRRDLRLASNAICSAVPVHWVPTSRTTWSIHAHHQWMTTEDMLTVWNRVWIEDNPWMEDKTPVTTWENVPYLGKREDQWCGSLIGLTSRATWAQNIPTAIQQVRSLIGNEEFLDYMPSMKRFRKEEESEGAIW

SEQ ID NO: 4814 - protein, 3290 aa, Artificial Sequence
  derived and/or modified protein sequence (wt) from DENV-3__KJ189266__SS-prME
TSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAVLPEEQDQNYVCKHTYVDRGWGNGCGLFGKGSLVTCAKFQCLEPIEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDVPCKIPFSTEDGHGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSASRAWNVWEVEDYGFGVFTTNIWLKLREVYTQLCDHRLMSAAVKDERAVHADMGYWIESQKNGSWKLEKASLIEVKTCTWPKSHTLWSNGVLESDMIIPKSLAGPISQHNHRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGKVDNFTMGVLCLAILFEEVMRGKFGKKHMIAGVFFTFVLLLSGQITWRDMAHTLIMIGSNASDRMGMGVTYLALIATFKIQPFLALGFFLRKLTSRENLLLGVGLAMATTLQLPEDIEQMANGIALGLMALKLITQFETYQLWTALISLTCSNTIFTLTVAWRTATLILAGVSLLPVCQSSSMRKTDWLPMAVAAMGVPPLPLFIFSLKDTLKRRSWPLNEGVMAVGLVSILASSLLRNDVPMAGPLVAGGLLIACYVITGTSADLTVEKAADITWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTYNGKRLEPNWASVKKDLISYGGGWRLSAQWQKGEEVQVIAIEPGKNPKNFQAMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKDFAAGRKSIALDLVTEIGRVPSHLAHRTRNALDNLVMLHTSEHGGRAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVASVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRSMPGTRRVMGITAEWLWRTLGRNKKPRLCTREEFTKKVRTNAAMGAVFTEENQWDSAKAAVEDEDFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPTGTVMDIISRKDQRGSGQVGTYGLNTFTNMEAQLIRQMEGEGVLSKADLENPHLPEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLRETACLGKAYAQMWSLMYFHRRDLRLASNAICSAVPVHWVPTSRTTWSIHAHHQWMTTEDMLTVWNRVWIEDNPWMEDKTPVTTWENVPYLGKREDQWCGSLIGLTSRATWAQNIPTAIQQVRSLIGNEEFLDYMPSMKRFRKEEESEGAIW

SEQ ID NO: 4815 - protein, 3290 aa, Artificial Sequence
  derived and/or modified protein sequence (wt) from DENV-3__KJ189268__SS-prME
TSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAVLPEEQDQNYVCKHTYVDRGWGNGCGLFGKGSLVTCAKFQCLEPIEGKVVQYENLKYTVIITVHTGDQHQVGNETQGVTAEITPQASTTEATLPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDAPCKIPFSTEDGHGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSASRAWNVWEVEDYGFGVFTTNIWLRLREVYTQLCDHRLMSAAVKDERAVHADMGYWIESQKNGSWKLEKASLIEVKTCTWPKSHTLWSNGVLESDMIIPKSLAGPISQHNHRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGKVDNFTMGVLCLAILFEEVMRGKFGKKHMIAGVFFTFVLLLSGQITWRDMAHTLIMIGSNASDRMGMGVTYLALIATFKIQPFLALGFFLRKLTSRENLLLGVGLAMATTLQLPEDIEQMANGIALGLMALKLITQFETYQLWTALISLTCSNTIFTLTVAWRTATLILAGVSLLPVCQSSSMRKTDWLPMAVAAMGVPPLPLFIFSLKDTLKRRSWPLNEGVMAVGLVSILASSLLRNDVPMAGPLVAGGLLIACYVITGTSADLTVEKAADITWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTYNGKRLEPNWASVKKDLISYGGGWRLSTQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKDFAAGRKSIALDLVTEIGRVPSHLAHRTKNALDNLVMLHTSEHGGRAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAATIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVASVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRSMPGTRRVMGITAEWLWRTLGRNKKPRLCTREEFTKKVRTNAAMGAVFTEENQWDSAKAAVEDEDFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPTGTVMDIISRKDQRGSGQVGTYGLNTFTNMEAQLIRQMEGEGVLSKADLENPHLPEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLRETACLGKAYAQMWSLMYFHRRDLRLASNAICSAVPVHWVPTSRTTWSIHAHHQWMTTEDMLTVWNRVWIEDNPWMEDKTPVTTWEDVPYLGKREDQWCGSLIGLTSRATWAQNIPTAIQQVRSLIGNEEFLDYMPSMKRFRKEEESEGAIW

SEQ ID NO: 4816 - protein, 3290 aa, Artificial Sequence
  derived and/or modified protein sequence (wt) from DENV-3__KJ189271__SS-prME
TSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAVLPEEQDQNYVCKHTYVDRGWGNGCGLFGKGSLVTCAKFQCLEPIEGKVVQYENLKYTVIITVHTGDQHQVGNETQGVTAEITPQASTTEATLPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDAPCKIPFSTEDGHGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSASRAWNVWEVEDYGFGVFTTNIWLRLREVYTQLCDHRLMSAAVKDERAVHADMGYWIESQKNGSWKLEKASLIEVKTCTWPKSHTLWSNGVLESDMIIPKSLAGPISQHNHRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGKVDNFTMGVLCLAILFEEVMRGKLGKKHMIAGVFFTFVLLLSGQITWRDMAHTLIMIGSNASDRMGMGVTYLALIATFKIQPFLALGFFLRKLTSRENLLLGVGLAMATTLQLPEDIEQMANGIALGLMALKLITQFETYQLWTALISLTCSNTIFTLTVAWRTATLILAGVSLLPVCQSSSMRKTDWLPMAVAAMGVPPLPLFIFSLKDTLKRRSWPLNEGVMAVGLVSILASSLLRNDVPMAGPLVAGGLLIACYVITGTSADLTVEKAADITWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTYNGKRLEPNWASVKKDLISYGGGWRLSTQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKDFAAGRKSIALDLVTEIGRVPSHLAHRTRNALDNLVMLHTSEHGGRAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVASVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRSMPGTRRVMGITAEWLWRTLGRNKKPRLCTREEFTKKVRTNAAMGAVFTEENQWDSAKAAVEDEDFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPTGTVMDIISRKDQRGSGQVGTYGLNTFTNMEAQLIRQMEGEGVLSKADLENPHLPEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLRETACLGKAYAQMWSLMYFHRRDLRLASNAICSAVPVHWVPTSRTTWSIHAHHQWMTTEDMLTVWNRVWIEDNPWMEDKTPVTTWEDVPYLGKREDQWCGSLIGLTSRATWAQNIPTAIQQVRSLIGNEEFLDYMPSMKRFRKEEESEGAIW

SEQ ID NO: 4817 - protein, 3290 aa, Artificial Sequence
  derived and/or modified protein sequence (wt) from DENV-3__KJ189272__SS-prME
TSLCLMMILPAALAFHLTSRDGEPRMIVGKNERGKSLLFKTASGINMCTLIAMDLGEMCDDTVTYKCPYITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAVLPEEQDQNYVCKHTYVDRGWGNGCGLFGKGSLVTCAKFQCLEPIEGKVVQYENLKYTVIITVHTGDQHQVGNETQGVTAEITPQASTTEATLPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDAPCKIPFSTEDGHGKAHNGRLITANPVVTKKEEPVSIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSASRAWNVWEVEDYGFGVFTTNIWLRLREVYTQLCDHRLMSAAVKDERAVHADMGYWIESQKNGSWKLEKASLIEVKTCTWPKSHTLWSNGVLESDMIIPKSLAGPISQHNHRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGKVDNFTMGVLCLAILFEEVMRGKFGKKHMIAGVFFTFVLLLSGQITWRDMAHTLIMIGSNASDRMGMGVTYLALIATFKIQPFLALGFFLRKLTSRENLLLGVGLAMATTLQLPEDIEQMANGIALGLMALKLITQFETYQLWTALISLTCSNTIFTLTVAWRTATLILAGVSLLPVCQSSSMRKTDWLPMAVAAMGVPPLPLFIFSLKDTLKRRSWPLNEGVMAVGLVSILASSLLRNDVPMAGPLVAGGLLIACYVITGTSADLTVEKAADITWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTYNGKRLEPNWASVKKDLISYGGGWRLSTQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKDFAAGRKSIALDLVTEIGRVPSHLAHRTRNALDNLVMLHTSEHGGRAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVASVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRSMPGTRRVMGITAEWLWRTLGRNKKPRLCTREEFTKKVRTNAAMGAVFTEENQWDSAKAAVEDEDFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPTGTVMDIISRKDQRGSGQVGTYGLNTFTNMEAQLIRQMEGEGVLSKADLENPHLPEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLRETACLGKAYAQMWSLMYFHRRDLRLASNAICSAVPVHWVPTSRTTWSIHAHHQWMTTEDMLTVWNRVWIEDNPWMEDKTPVTTWEDVPYLGKREDQWCGSLIGLTSRATWAQNIPTAIQQVRSLIGNEEFLDYMPSMKRFRKEEESEGAIW

SEQ ID NO: 4818 - protein, 3290 aa, Artificial Sequence
  derived and/or modified protein sequence (wt) from DENV-3__KJ189273__SS-prME
TSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAVLPEEQDQNYVCKHTYVDRGWGNGCGLFGKGSLVTCAKFQCLEPIEGKVVQYENLKYTVIITVHTGDQHQVGNETQGVTAEITPQASTTEVTLPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDAPCKIPFSTEDGHGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSASRAWNVWEVEDYGFGVFTTNIWLRLREVYTQLCDHRLMSAAVKDERAVHADMGYWIESQKNGSWKLEKASLIEVKTCTWPKSHTLWSNGVLESDMIIPKSLAGPISQHNHRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGKVDNFTMGVLCLAILFEEVMRGKFGKKHMIAGVFFTFVLLLSGQITWRDMAHTLIMIGSNASDRMGMGVTYLALIATFKIQPFLALGFFLRKLTSRENLLLGVGLAMATTLQLPEDIEQMANGIALGLMALKLITQFEIYQLWTALISLTCSNTIFTLTVAWRTATLILAGVSLLPVCQSSSMRKTDWLPMAVAAMGVPPLPLFIFSLKDTLKRRSWPLNEGVMAVGLVSILASSLLRNDVPMAGPLVAGGLLIACYVITGTSADLTVEKAADITWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTYNGKRLEPNWASVKKDLISYGGGWRLSTQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKDFAAGRKSIALDLVTEIGRVPSHLAHRTRNALDNLVMLHTSEHGGRAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVASVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRSMPGTRRVMGITAEWLWRTLGRNKKPRLCTREEFTKKVRTNAAMGAVFTEENQWDSAKAAVEDEDFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPTGTVMDIISRKDQRGSGQVGTYGLNTFTNMEAQLIRQMEGEGVLSKADLENPHLPEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLRETACLGKAYAQMWSLMYFHRRDLRLASNAICSAVPVHWVPTSRTTWSIHAHHQWMTTEDMLTVWNRVWIEDNPWMEDKTPVTTWEDVPYLGKREDQWCGSLIGLTSRATWAQNIPTAIQQVRSLIGNEEFLDYMPSMKRFRKEEESEGAIW

SEQ ID NO: 4819 - protein, 3290 aa, Artificial Sequence
  derived and/or modified protein sequence (wt) from DENV-3__KJ189274__SS-prME
TSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAVLPEEQDQNYVCKHTYVDRGWGNGCGLFGKGSLVTCAKFQCLEPIEGKVVQYENLKYTVIITVHTGDQHQVGNETQGVTAEITPQASTTEATLPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDAPCKIPFSTEDGHGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDIIGVLEQGRRTLTPQPMELKYSWKTWGKAKIVTAETQNSSFIIDGPNTPECPSASRAWNVWEVEDYGFGVFTTNIWLRLREVYTQLCDHRLMSAAVKDERAVHADMGYWIESQKNGSWKLEKASLIEVKTCTWPKSHTLWSNGVLESDMIIPKSLAGPISQHNHRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGKVDNFTMGVLCLAILFEEVMRGKFGKKHMIAGVFFTFVLLLSGQITWRDMAHTLIMIGSNASDRMGMGVTYLALIATFKIQPFLALGFFLRKLTSRENLLLGVGLAMATTLQLPEDIEQMANGIALGLMALKLITQFEIYQLWTALISLTCSNTIFTLTVAWRTATLILAGVSLLPVCQSSSMRKTDWLPMAVAAMGVPPLPLFIFSLKDTLKRRSWPLNEGVMAVGLVSILASSLLRNDVPMAGPLVAGGLLIACYVITGTSADLTVEKAADITWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTYNGKRLEPNWASVKKDLISYGGGWRLSTQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKDFAAGRKSIALDLVTEIGRVPSHLAHRTRNALDNLVMLHTSEHGGRAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVASVNMVSRLLLNRFTMTHRRPTIEKDVDLGAGTRHVNAEPETPNMDVIGERIKRIREEHNSTWHYDDENPYKTWAYHGSYEVKATGSASSMINGVVKLLTKPWDVVPMVTQMAMTDTTPFGQQRVFKEKVDTRTPRSMPGTRRVMGITAEWLWRTLGRNKKPRLCTREEFTKKVRTNAAMGAVFTEENQWDSAKAAVEDEDFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPTGTVMDIISRKDQRGSGQVGTYGLNTFTNMEAQLIRQMEGEGVLSKADLENPHLPEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLRETACLGKAYAQMWSLMYFHRRDLRLASNAICSAVPVHWVPTSRTTWSIHAHHQWMTTEDMLTVWNRVWIEDNPWMEDKTPVTTWEDVPYLGKREDQWCGSLIGLTSRATWAQNIPTAIQQVRSLIGNEEFLDYMPSMKRFRKEEESEGAIW

SEQ ID NO: 4820 - protein, 3290 aa, Artificial Sequence
  derived and/or modified protein sequence (wt) from DENV-3__KJ189275__SS-prME
TSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAVLPEEQDQNYVCKHTYVDRGWGNGCGLFGKGSLVTCAKFQCLEPIEGKVVQYENLKYTVIITVHTGDQHQVGNETQGVTAEITPQASTTEATLPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDAPCKIPFSTEDGHGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDIIGVLEQGRRTLTPQPMELKYSWKTWGKAKIVTAETQNSSFIIDGPNTPECPSASRAWNVWEVEDYGFGVFTTNIWLRLREVYTQLCDHRLMSAAVKDERAVHADMGYWIESQKNGSWKLEKASLIEVKTCTWPKSHTLWSNGVLESDMIIPKSLAGPISQHNHRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGKVDNFTMGVLCLAILFEEVMRGKFGKKHMIAGVFFTFVLLLSGQITWRDMAHTLIMIGSNASDRMGMGVTYLALIATFKIQPFLALGFFLRKLTSRENLLLGVGLAMATTLQLPEDIEQMANGIALGLMALKLITQFETYQLWTALISLTCSNTIFTLTVAWRTATLILAGVSLLPVCQSSSMRKTDWLPMAVAAMGVPPLPLFIFSLKDTLKRRSWPLNEGVMAVGLVSILASSLLRNDVPMAGPLVAGGLLIACYVITGTSADLTVEKAADITWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTYNGKRLEPNWASVKKDLISYGGGWRLSTQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKDFAAGRKSIALDLVTEIGRVPSHLAHRTRNALDNLVMLHTSEHGGRAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVASVNMVSRLLLNRFTMTHRRPTIEKDVDLGAGTRHVNAEPETPNMDVIGERIKRIREEHNSTWHYDDENPYKTWAYHGSYEVKATGSASSMINGVVKLLTKPWDVVPMVTQMAMTDTTPFGQQRVFKEKVDTRTPRSMPGTRRVMGITAEWLWRTLGRNKKPRLCTREEFTKKVRTNAAMGAVFTEENQWDSAKAAVEDEDFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPTGTVMDIISRKDQRGSGQVGTYGLNTFTNMEAQLIRQMEGEGVLSKADLENPHLPEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLRETACLGKAYAQMWSLMYFHRRDLRLASNAICSAVPVHWVPTSRTTWSIHAHHQWMTTEDMLTVWNRVWIEDNPWMEDKTPVTTWEDVPYLGKREDQWCGSLIGLTSRATWAQNIPTAIQQVRSLIGNEEFLDYMPSMKRFRKEEESEGAIW

SEQ ID NO: 4821 - protein, 3290 aa, Artificial Sequence
  derived and/or modified protein sequence (wt) from DENV-3__KJ189276__SS-prME
TSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAVLPEEQDQNYVCKHTYVDRGWGNGCGLFGKGSLVTCAKFQCLEPIEGKVVQYENLKYTVIITVHTGDQHQVGNETQGVTAEITPQASTTEATLPEYGTLGLQCSPRTGLDFNEMILLTMKNKAWMVHRQWFFDLPLPWTSGATSETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDAPCKIPFSTEDGHGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSASRAWNVWEVEDYGFGVFTTNIWLRLREVYTQLCDHRLMSAAVKDERAVHADMGYWIESQKNGSWKLEKASLIEVKTCTWPKSHTLWSNGVLESDMIIPKSLAGPISQHNHRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGKVDNFTMGVLCLAILFEEVMRGKFGKKHMIAGVFFTFVLLLSGQITWRDMAHTLIMIGSNASDRMGMGVTYLALIATFKIQPFLALGFFLRKLTSRENLLLGVGLAMATTLQLPEDIEQMANGIALGLMALKLITQFETYQLWTALISLTCSNTIFTLTVAWRTATLILAGVSLLPVCQSSSMRKTDWLPMAVAAMGVPPLPLFIFSLKDTLKRRSWPLNEGVMAVGLVSILASSLLRNDVPMAGPLVAGGLLIACYVITGTSADLTVEKAADITWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTYNGKRLEPNWASVKKDLISYGGGWRLSTQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKDFAAGRKSIALDLVTEIGRVPSHLAHRTRNALDNLVMLHTSEHGGRAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVASVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRSMPGTRRVMGITAEWLWRTLGRNKKPRLCTREEFTKKVRTNAAMGAVFTEENQWNSAKAAVEDEDFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRRLANAIFKLTYQNKVVKVQRPTPTGTVMDIISRKDQRGSGQVGTYGLNTFTNMEAQLIRQMEGEGVLSKADLENPHLPEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLRETACLGKAYAQMWSLMYFHRRDLRLASNAICSAVPVHWVPTSRTTWSIHAHHQWMTTEDMLTVWNRVWIEDNPWMEDKTPVTTWEDVPYLGKREDQWCGSLIGLTSRATWAQNIPTAIQQVRSLIGNEEFLDYMPSMKRFRKEEESEGAIW

SEQ ID NO: 4822 - protein, 3290 aa, Artificial Sequence
  derived and/or modified protein sequence (wt) from DENV-3__KJ189277__SS-prME
TSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAVLPEEQDQNYVCKHTYVDRGWGNGCGLFGKGSLVTCAKFQCLEPIEGKVVQYENLKYTVIITVHTGDQHQVGNETQGVTAEITPQASTTEATLPEYGTLGLQCSPRTGLDFNEMILLTMKNKAWMVHRQWFFDLPLPWTSGATSETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDAPCKIPFSTEDGHGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSASRAWNVWEVEDYGFGVFTTNIWLRLREAYTQLCDHRLMSAAVKDERAVHADMGYWIESQKNGSWKLEKASLIEVKTCTWPKSHTLWSNGVLESDMIIPKSLAGPISQHNHRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGKVDNFTMGVLCLAILFEEVMRGKFGKKHMIAGVFFTFVLLLSGQITWRDMAHTLIMIGSNASDRMGMGVTYLALIATFKIQPFLALGFFLRKLTSRENLLLGVGLAMATTLQLPEDIEQMANGIALGLMALKLITQFETYQLWTALISLTCSNTIFTLTVAWRTATLILAGVSLLPVCQSSSMRKTDWLPMAVAAMGVPPLPLFIFSLKDTLKRRSWPLNEGVMAVGLVSILASSLLRNDVPMAGPLVAGGLLIACYVITGTSADLTVEKAADITWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTYNGKRLEPNWASVKKDLISYGGGWRLSTQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKDFAAGRKSIALDLVTEIGRVPSHLAHRTRNALDNLVMLHTSEHGGRAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVASVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRSMPGTRRVMGITAEWLWRTLGRNKKPRLCTREEFTKKVRTNAAMGAVFTEENQWNSAKAAVEDEDFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRRLANAIFKLTYQNKVVKVQRPTPTGTVMDIISRKDQRGSGQVGTYGLNTFTNMEAQLIRQMEGEGVLSKADLENPHLPEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLRETACLGKAYAQMWSLMYFHRRDLRLASNAICSAVPVHWVPTSRTTWSIHAHHQWMTTEDMLTVWNRVWIEDNPWMEDKTPVTTWEDVPYLGKREDQWCGSLIGLTSRATWAQNIPTAIQQVRSLIGNEEFLDYMPSMKRFRKEEESEGAIW

SEQ ID NO: 4823 - protein, 3290 aa, Artificial Sequence
  derived and/or modified protein sequence (wt) from DENV-3__KJ189278__SS-prME
TSLCLMMILPAALAFHLTSRDGEPRMIVGKNERGKSLLFKTASGTNMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAVLPEEQDQNYVCKHTYVDRGWGNGCGLFGKGSLVTCAKFQCLEPIEGKVVQYENLKYTVIITVHTGDQHQVGNETQGVTAEITPQASTTEATLPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDAPCKIPFSTEDGHGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQADMGCVINWKGKELKCGSGIFVTNEVHTWTEQYKFQADSPKRLATAIAGAWENGVCGIRSTTRMENLLWKQIANELNYILWENNVKLTVVVGDIIGVLEQGKRTLTPQPMELKYSWKTWGKAKIVTAETQNSSFIIDGPNTPECPSASRAWNVWEVEDYGFGVFTTNIWLRLREVYTQLCDHRLMSAAVKDERAVHADMGYWIESQKNGSWKLEKASLIEVKTCTWPKSHTLWSNGVLESDMIIPKSLAGPISQHNHRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGKVDNFTMGVLCLAILFEEVMRGKFGKKHMIAGVFFTFVLLLSGQITWRDMAHTLIMIGSNASDRMGMGVTYLALIATFKIQPFLALGFFLRKLTSRENLLLGVGLAMATTLQLPEDIEQMANGIALGLMALKLITQFETYQLWTALISLTCSNTIFTLTVAWRTATLILAGVSLLPVCQSSSMRKTDWLPMAVAAMGVPPLPLFIFSLKDTLKRRSWPLNEGVMAVGLVSILASSLLRNDVPMAGPLVAGGLLIACYVITGTSADLTVEKAADITWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTYNGKRLEPNWASVKKDLISYGGGWRLSTQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKDFAAGRKSIALDLVTEIGRVPSHLAHRTRNALDNLVMLHTSEHGGRAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVASVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRSMPGTRRVMGITAEWLWRTLGRNKKPRLCTREEFTKKVRTNAAMGAVFTEENQWDSAKAAVEDEDFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPTGTVMDIISRKDQRGSGQVGTYGLNTFTNMEAQLIRQMEGEGVLSKADLENPHLPEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLRETACLGKAYAQMWSLMYFHRRDLRLASNAICSAVPVHWVPTSRTTWSIHAHHQWMTTEDMLTVWNRVWIEDNPWMEDKTPVTTWEDVPYLGKREDQWCGSLIGLTSRATWAQNIPTAIQQVRSLIGNEEFLDYMPSMKRFRKEEESEGAIW

SEQ ID NO: 4824 - protein, 3290 aa, Artificial Sequence
  derived and/or modified protein sequence (wt) from DENV-3__KJ189279__SS-prME
TSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAVLPEEQDQNYVCKHTYVDRGWGNGCGLFGKGSLVTCAKFQCLEPIEGKVVQYENLKYTVIITVHTGDQHQVGNETQGVTAEITPQASTTEVTLPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDAPCKIPFSTEDGHGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSASRAWNVWEVEDYGFGVFTTNIWLRLREVYTQLCDHRLMSAAIKDERAVHADMGYWIESQKNGSWKLEKASLIEVKTCTWPKSHTLWSNGVLESDMIIPKSLAGPISQHNHRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGKVDNFTMGVLCLAILFEEVMRGKFGKKHMIAGVFFTFVLLLSGQITWRDMAHTLIMIGSNASDRMGMGVTYLALIATFKIQPFLALGFFLRKLTSRENLLLGVGLAMATTLQLPEDIEQMANGIALGLMALKLITQFETYQLWTALISLTCSNTIFTLTVAWRTATLILAGVSLLPVCQSSSMRKTDWLPMAVAAMGVPPLPLFIFSLKDTLKRRSWPLNEGVMAVGLVSILASSLLRNDVPMAGPLVAGGLLIACYVITGTSADLTVEKAADITWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTYNGKRLEPNWASVKKDLISYGGGWRLSTQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKDFAAGRKSIALDLVTEIGRVPSHLAHRTRNALDNLVMLHTSEHGGRAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVASVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRSMPGTRRVMGITAEWLWRTLGRNKKPRLCTREEFTKKVRTNAAMGAVFTEENQWDSAKAAVEDEDFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPTGTVMDIISRKDQRGSGQVGTYGLNTFTNMEAQLIRQMEGEGVLSKADLENPHLPEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLRETACLGKAYAQMWSLMYFHRRDLRLASNAICSAVPVHWVPTSRTTWSIHAHHQWMTTEDMLTVWNRVWIEDNPWMEDKTPVTTWEDVPYLGKREDQWCGSLIGLTSRATWAQNIPTAIQQVRSLIGNEEFLDYMPSMKRFRKEEESEGAIW

SEQ ID NO: 4825 - protein, 3290 aa, Artificial Sequence
  derived and/or modified protein sequence (wt) from DENV-3__KJ189280__SS-prME
TSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAVLPEEQDQNYVCKHTYVDRGWGNGCGLFGKGSLVTCAKFQCLEPIEGKVVQYENLKYTVIITVHTGDQHQVGNETQGVTAEITPQASTTEATLPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDAPCKIPFSTEDGHGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSASRAWNVWEVEDYGFGVFTTNIWLRLREVYTQLCDHRLMSAAVKDERAVHADMGYWIESQKNGSWKLEKASLIEVKTCTWPKSHTLWSNGVLESDMIIPKSLAGPISQHNHRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGKVDNFTMGVLCLAILFEEVMRGKFGKKHMIAGVFFTFVLLLSGQITWRDMAHTLIMIGSNASDRMGMGVTYLALIATFKIQPFLALGFFLRKLTSRENLLLGVGLAMATTLQLPEDIEQMANGIALGLMALKLITQFETYQLWTALISLTCSNTIFTLTVAWRTATLILAGVSLLPVCQSSSMRKTDWLPMAVAAMGVPPLPLFIFSLKDTLKRRSWPLNEGVMAVGLVSILASSLLRNDVPMAGPLVAGGLLIACYVITGTSADLTVEKAADITWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTYNGKRLEPNWASVKKDLISYGGGWRLSTQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVSSEGIKYTDRKWCFDGQRNNQILEENMDVEIWTKEGEKKKLRPRWLDARTYSDPLALKEFKDFAAGRKSIALDLVTEIGRVPSHLAHRTRNALDNLVMLHTSEHGGRAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVASVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRSMPGTRRVMGITAEWLWRTLGRNKKPRLCTREEFTKKVRTNAAMGAVFTEENQWDSAKAAVEDEDFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPTGTVMDIISRKDQRGSGQVGTYGLNTFTNMEAQLIRQMEGEGVLSKADLENPHLPEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLRETACLGKAYAQMWSLMYFHRRDLRLASNAICSAVPVHWVPTSRTTWSIHAHHQWMTTEDMLTVWNRVWIEDNPWMEDKTPVTTWEDVPYLGKREDQWCGSLIGLTSRATWAQNIPTAIQQVRSLIGNEEFLDYMPSMKRFRKEEESEGAIW

SEQ ID NO: 4826 - protein, 3290 aa, Artificial Sequence
  derived and/or modified protein sequence (wt) from DENV-3__KJ189281__SS-prME
TSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAVLPEEQDQNYVCKHTYVDRGWGNGCGLFGKGSLVTCAKFQCLEPIEGKVVQYENLKYTVIITVHTGDQHQVGNETQGVTAEITPQASTTEATLPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDAPCKIPFSTEDGHGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSASRAWNVWEVEDYGFGVFTTNIWLRLREVYTQLCDHRLMSAAVKDERAVHADMGYWIESQKNGSWKLEKASLIEVKTCTWPKSHTLWSNGVLESDMIIPKSLAGPISQHNHRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGKVDNFTMGVLCLAILFEEVMRGKFGKKHMIAGVFFTFVLLLSGQITWRDMAHTLIMIGSNASDRMGMGVTYLALIATFKIQPFLVLGFFLRKLTSRENLLLGVGLAMATTLQLPEDIEQMANGIALGLMALKLITQFETYQLWTALISLTCSNTIFTLTVAWRTATLILAGVSLLPVCQSSSMRKTDWLPMAVAAMGVPPLPLFIFSLKDTLKRRSWPLNEGVMAVGLVSILASSLLRNDVPMAGPLVAGGLLIACYVITGTSADLTVEKAADITWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTYNGKRLEPNWASVKKDLISYGGGWRLSTQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKDFAAGRKSIALDLVTEIGRVPSHLAHRTRNALDNLVMLHTSEHGGRAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVASVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRSMPGTRRVMGITAEWLWRTLGRNKKPRLCTREEFTKKVRTNAAMGAVFTEENQWDSAKAAVEDEDFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPTGTVMDIISRKDQRGSGQVGTYGLNTFTNMEAQLIRQMEGEGVLSKADLENPHLPEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLRETACLGKAYAQMWSLMYFHRRDLRLASNAICSAVPVHWVPTSRTTWSIHAHHQWMTTEDMLTVWNRVWIEDNPWMEDKTPVTTWEDVPYLGKREDQWCGSLIGLTSRATWAQNIPTAIQQVRSLIGNEEFLDYMPSMKRFRKEEESEGAIW

SEQ ID NO: 4827 - protein, 3290 aa, Artificial Sequence
  derived and/or modified protein sequence (wt) from DENV-3__KJ189282__SS-prME
TSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAVLPEEQDQNYVCKHTYVDRGWGNGCGLFGKGSLVTCAKFQCLEPIEGKVVQYENLKYTVIITVHTGDQHQVGNETQGVTAEITPQASTTEATLPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDAPCKIPFSTEDGHGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDIIGILEQGKRTLTPQPMELKYSWKTWGKAKIVTAETQNSSFIIDGPNTPECPSASRAWNVWEVEDYGFGVFTTNIWLRLREAYTQLCDHRLMSAAVKDERAVHADMGYWIESQKNGSWKLEKASLIEVKTCTWPKSHTLWSNGVLESDMIIPKSLAGPISQHNHRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGKVDNFTMGVLCLAILFEEVMRGKFGKKHMIAGVFFTFVLLLSGQITWRDMAHTLIMIGSNASDRMGMGVTYLALIATFKIQPFLALGFFLRKLTSRENLLLGVGLAMATTLQLPEDIEQMANGIALGLMALKLITQFETYQLWTALISLTCSNTIFTLTVAWRTATLILAGVSLLPVCQSSSMRKTDWLPMAVAAMGVPPLPLFIFSLKDTLKRRSWPLNEGVMAVGLVSILASSLLRNDVPMAGPLVAGGLLIACYVITGTSADLTVEKAADITWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTYNGKRLEPNWASVKKDLISYGGGWRLSTQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKDFAAGRKSIALDLVTEIGRVPSHLAHRTRNALDNLVMLHTSEHGGRAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVASVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRSMAGTRRVMGITAEWLWRTLGRNKKPRLCTREEFTKKVRTNAAMGAVFTEENQWDSAKAAVEDEDFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPTGTVMDIISRKDQRGSGQVGTYGLNTFTNMEAQLIRQMEGEGVLSKADLENPHLPEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLRETACLGKAYAQMWSLMYFHRRDLRLASNAICSAVPVHWVPTSRTTWSIHAHHQWMTTEDMLTVWNRVWIEDNPWMEDKTPVTTWEDVPYLGKREDQWCGSLIGLTSRATWAQNIPTAIQQVRSLIGNEEFLDYMPSMKRFRKEEESEGAIW

SEQ ID NO: 4828 - protein, 3290 aa, Artificial Sequence
  derived and/or modified protein sequence (wt) from DENV-3__KJ189283__SS-prME
TSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAVLPEEQDQNYVCKHTYVDRGWGNGCGLFGKGSLVTCAKFQCLEPIEGKVVQYENLKYTVIITVHTGDQHQVGNETQGVTAEITPQASTTEATLPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDAPCKIPFSTEDGHGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSASRAWNVWEVEDYGFGVFTTNIWLRLREVYTQLCDHRLMSAAVKDERAVHADMGYWIESQKNGSWKLEKASLIEVKTCTWPKSHTLWSNGVLESDMIIPKSLAGPISQHNHRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGKVDNFTMGVLCLAILFEEVMRGKFGKKHMIAGVFFTFVLLLSGQITWRDMAHTLIMIGSNASDRMGMGVTYLALIATFKIQPFLALGFFLRKLTSRENLLLGVGLAMATTLQLPEDIEQMANGIALGLMALKLITQFETYQLWTALISLTCSKTIFTLTVAWRTATLILAGVSLLPVCQSSSMRKTDWLPMAVAAMGVPPLPLFIFSLKDTLKRRSWPLNEGVMAVGLVSILASSLLRNDVPMAGPLVAGGLLIACYVITGTSADLTVEKAADITWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTYNGKRLEPNWASVKKDLISYGGGWRLSTQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKDFAAGRKSIALDLVTEIGRVPSHLAHRTRNALDNLVMLHTSEHGGRAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVASVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRSMPGTRRVMGITAEWLWRTLGRNKKPRLCTREEFTKKVRTNAAMGAVFTEENQWDSAKAAVEDEDFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPTGTVMDIISRKDQRGSGQVGTYGLNTFTNMEAQLIRQMEGEGVLSKADLENPHLPEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLRETACLGKAYAQMWSLMYFHRRDLRLASNAICSAVPVHWVPTSRTTWSIHAHHQWMTTEDMLTVWNRVWIEDNPWMEDKTPVTTWEDVPYLGKREDQWCGSLIGLTSRATWAQNILTAIQQVRSLIGNEEFLDYMPSMKRFRKEEESEGAIW

SEQ ID NO: 4829 - protein, 3290 aa, Artificial Sequence
  derived and/or modified protein sequence (wt) from DENV-3__KJ189284__SS-prME
TSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAVLPEEQDQNYVCKHTYVDRGWGNGCGLFGKGSLVTCAKFQCLEPIEGKVVQYENLKYTVIITVHTGDQHQVGNETQGVTAEITPQASTTEVTLPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDAPCKIPFSTEDGHGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSASRAWNVWEVEDYGFGVFTTNIWLRLREVYTQLCDHRLMSAAVKDERAVHADMGYWIESQKNGSWKLEKASLIEVKTCTWPKSHTLWSNGVLESDMIIPKSLAGPISQHNHRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGKVDNFTMGVLCLAILFEEVMRGKFGKKHMIAGVFFTFVLLLSGQITWRDMAHTLIMIGSNASDRMGMGVTYLALIATFKIQPFLALGFFLRKLTSRENLLLGVGLAMATTLQLPEDIEQMANGIALGLMALKLITQFETYQLWTALISLTCSNTIFTLTVAWRTATLILAGVSLLPVCQSSSMRKTDWLPMAVAAMGVPPLPLFIFSLKDTLKRRSWPLNEGVMAVGLVSILASSLLRNDVPMAGPLVAGGLLIACYVITGTSADLTVEKAADITWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTYNGKRLEPNWASVKKDLISYGGGWRLSTQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKDFAAGRKSIALDLVTEIGRVPSHLAHRTRNALDNLVMLHTSEHGGRAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVASVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRSMPGTRRVMGITAEWLWRTLGRNKKPRLCTREEFTKKVRTNAAMGAVFTEENQWDSAKAAVEDEDFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPTGTVMDIISRKDQRGSGQVGTYGLNTFTNMEAQLIRQMEGEGVLSKADLENPHLPEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLRETACLGKAYAQMWSLMYFHRRDLRLASNAICSAVPVHWVPTSRTTWSIHAHHQWMTTEDMLTVWNRVWIEDNPWMEDKTPVTTWEDVPYLGKREDQWCGSLIGLTSRATWAQNIPTAIQQVRSLIGNEEFLDYMPSMKRFRKEEESEGAIW

SEQ ID NO: 4830 - protein, 3290 aa, Artificial Sequence
  derived and/or modified protein sequence (wt) from DENV-3__KJ189286__SS-prME
TSFCLMMILPAALAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAVLPEEQDQNYVCKHTYVDRGWGNGCGLFGKGSLVTCAKFQCLEPIEGKVVQYENLKYTVIITVHTGDQHQVGNETQGVTAEITPQASTTEATLPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDAPCKIPFSTEDGHGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSASRAWNVWEVEDYGFGVFTTNIWLRLREVYTQLCDHRLMSAAVKDERAVHADMGYWIESQKNGSWKLEKASLIEVKTCTWPKSHTLWSNGVLESDMIIPKSLAGPISQHNHRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGKVDNFTMGVLCLAILFEEVMRGKFGKKHMIAGVFFTFVLLLSGQITWRDMAHTLIMIGSNASDRMGMGVTYLALIATFKIQPFLALGFFLRKLTSRENLLLGVGLAMATTLQLPEDIEQMANGIALGLMALKLITQFETYQLWTALISLTCSNTIFTLTVAWRTATLILAGVSLLPVCQSSSMRKTDWLPMAVAAMGVPPLPLFIFNLKDTLKRRSWPLNEGVMAVGLVSILASSLLRNDVPMAGPLVAGGLLIACYVITGTSADLTVEKAADITWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTYNGKRLEPNWASVKKDLISYGGGWRLSTQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKDFAAGRKSIALDLVTEIGRVPSHLAHRTRNALDNLVMLHTSEHGGRAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVASVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRSMPGTRRVMGITAEWLWRTLGRNKKPRLCTREEFTKKVRTNAAMGAVFTEENQWDSAKAAVEDEDFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPTGTVMDIISRKDQRGSGQVGTYGLNTFTNMEAQLIRQMEGEGVLSKADLENPHLPEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLRETACLGKAYAQMWSLMYFHRRDLRLASNAICSAVPVHWVPTSRTTWSIHAHHQWMTTEDMLTVWNRVWIEDNPWMEDKTPVTTWEDVPYLGKREDQWCGSLIGLTSRATWAQNIPTAIQQVRSLIGNEEFLDYMPSMKRFRKEEESEGAIW

SEQ ID NO: 4831 - protein, 3290 aa, Artificial Sequence
  derived and/or modified protein sequence (wt) from DENV-3__KJ189287__SS-prME
TSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAVLPEEQDQNYVCKHTYVDRGWGNGCGLFGKGSLVTCAKFQCLEPIEGKVVQYENLKYTVIITVHTGDQHQVGNETQGVTAEITPQASTTEATLPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDAPCKIPFSTEDGHGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDIIGILEQGKRTLTPQPMELKYSWKTWGKAKIVTAETQNSSFIIDGPNTPECPSASRAWNVWEVEDYGFGVFTTNIWLRLREVYTQLCDHRLMSAAVKDERAVHADMGYWIESQKNGSWKLEKASLIEVKTCTWPKSHTLWSNGVLESDMIIPKSLAGPISQHNHRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGKVDNFTMGVLCLAILFEEVMRGKFGKKHMIAGVFFTFVLLLSGQITWRNMAHTLIMIGSNASDRMGMGVTYLALIATFKIQPFLVLGFFLRKLTSRENLLLGVGLAMATTLQLPEDIEQMANGIALGLMALKLITQFETYQLWTALISLTCSNTIFTLTVAWRTATLILAGVSLLPVCQSSSMRKTDWLPMAVAAMGVPPLPLFIFSLKDTLKRRSWPLNEGVMAVGLVSILASSLLRNDVPMAGPLVAGGLLIACYVITGTSADLTVEKAADITWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTYNGKRLEPNWASVKKDLISYGGGWRLSTQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKDFAAGRKSIALDLVTEIGRVPSHLAHRTRNALDNLVMLHTSEHGGRAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVASVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRSMAGTRRVMGITAEWLWRTLGRNKKPRLCTREEFTKKVRTNAAMGAVFTEENQWDSAKAAVEDEDFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPTGTVMDIISRKDQRGSGQVGTYGLNTFTNMEAQLIRQMEGEGVLSKADLENPHLPEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLRETACLGKAYAQMWSLMYFHRRDLRLASNAICSAVPVHWVPTSRTTWSIHAHHQWMTTEDMLTVWNRVWIEDNPWMEDKTPVTTWEDVPYLGKREDQWCGSLIGLTSRATWAQNIPTAIQQVRSLIGNEEFLDYMPSMKRFRKEEESEGAIW

SEQ ID NO: 4832 - protein, 3290 aa, Artificial Sequence
  derived and/or modified protein sequence (wt) from DENV-3__KJ189288__SS-prME
TSLCLMMILPAALAFHLTSRDGEPRMIVGKNERGKSLLFKTASGTNMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAVLPEEQDQNYVCKHTYVDRGWGNGCGLFGKGSLVTCAKFQCLEPIEGKMVQYENLKYTVIITVHTGDQHQVGNETQGVTAEITPQASTTEATLPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDAPCKIPFSTEDGHGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQADMGCVINWKGKELKCGSGIFVTNEVHTWTEQYKFQADSPKRLATAIAGAWENGVCGIRSTTRMENLLWKQIANELNYILWENNVKLTVVVGDIIGVLEQGKRTLTPQPMELKYSWKTWGKAKIVTAETQNSSFIIDGPNTPECPSASRAWNVWEVEDYGFGVFTTNIWLRLREAYTQLCDHRLMSAAVKDERAVHADMGYWIESQKNGSWKLEKASLIEVKTCTWPKSHTLWSNGVLESDMIIPKSLAGPISQHNHRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGKVDNFTMGVLCLAILFEEVMRGKFGKKHMIAGVFFTFVLLLSGQITWRDMAHTLIMIGSNASDRMGMGVTYLALIATFKIQPFLALGFFLRKLTSRENLLLGVGLAMATTLQLPEDIEQMANGIALGLMALKLITQFETYQLWTALISLTCSNTIFTLTVAWRTATLILAGVSLLPVCQSSSMRKTDWLPMAVAAMGVPPLPLFIFSLKDTLKRRSWPLNEGVMAVGLVSILASSLLRNDVPMAGPLVAGGLLIACYVITGTSADLTVEKAADITWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTYNGKRLEPNWASVKKDLISYGGGWRLSTQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKDFAAGRKSIALDLVTEIGRVPSHLAHRTRNALDNLVMLHTSEHGGRAYRHAVEELPETMETLLLLGLMILLTGGAMLFLISGKGIGKTSIGLICVIASSGMLWMAEIPLQWIASAIVLEFFMMVLLVPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVASVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRSMPGTRRVMGITAEWLWRTLGRNKKPRLCTREEFTKKVRTNAAMGAVFTEENQWDSAKAAVEDEDFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPTGTVMDIISRKDQRGSGQVGTYGLNTFTNMEAQLIRQMEGEGVLSKADLENPHLPEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLRETACLGKAYAQMWSLMYFHRRDLRLASNAICSAVPVHWVPTSRTTWSIHAHHQWMTTEDMLTVWNRVWIEDNPWMEDKTPVTTWEDVPYLGKREDQWCGSLIGLTSRATWAQNIPTAIQQVRSLIGNEEFLDYMPSMKRFRKEEESEGAIW

SEQ ID NO: 4833 - protein, 3290 aa, Artificial Sequence
  derived and/or modified protein sequence (wt) from DENV-3__KJ189289__SS-prME
TSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAVLPEEQDQNYVCKHTYVDRGWGNGCGLFGKGSLVTCAKFQCLEPIEGKVVQYENLKYTVIITVHTGDQHQVGNETQGVTAEITPQASTTEATLPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDAPCKIPFSTEDGHGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDTIGVLEQGKRTLTPQPMELKYSWKTWGKAKIVTAETQNSSFIIDGPNTPECPSASRAWNVWEVEDYGFGVFTTNIWLRLREVYTQLCDHRLMSAAVKDERAVHADMGYWIESQKNGSWKLEKASLIEVKTCTWPKSHTLWSNGVLESDMIIPKSLAGPISQHNHRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGKVDNFTMGVLCLAILFEEVMRGKFGKKHMIAGVFFTFVLLLSGQITWRDMAHTLIMIGSNASDRMGMGVTYLALIATFKIQPFLALGFFLRKLTSRENLLLGVGLAMATTLQLPEDIEQMANGIALGLMALKLITQFETYQLWTALISLTCSNTIFTLTVAWRTATLILAGVSLLPVCQSSSMRKTDWLPMAVAAMGVPPLPLFIFSLKDTLKRRSWPLNEGVMAVGLVSILASSLLRNDVPMAGPLVAGGLLIACYVITGTSADLTVEKAADITWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTYNGKRLEPNWASVKKDLISYGGGWRLSTQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKDFAAGRKSIALDLVTEIGRVPSHLAHRTRNALDNLVMLHTSEHGGRAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAAIIAANEMGLLETTKRDLGMSKEPGVVSSTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVASVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRSMPGTRRVMGITAEWLWRTLGRNKKPRLCTREEFTKKVRTNAAMGAVFTEENQWDSAKTAVEDEDFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPTGTVMDIISRKDQRGSGQVGTYGLNTFTNMEAQLIRQMEGEGVLSKADLENPHLPEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLRETACLGKAYAQMWSLMYFHRRDLRLASNAICSAVPVHWVPTSRTTWSIHAHHQWMTTEDMLTVWNRVWIEDNPWMEDKTPVTTWEDVPYLGKREDQWCGSLIGLTSRATWAQNIPTAIQQVRSLIGNEEFLDYMPSMKRFRKEEESEGAIW

SEQ ID NO: 4834 - protein, 3290 aa, Artificial Sequence
  derived and/or modified protein sequence (wt) from DENV-3__KJ189290__SS-prME
TSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAVLPEEQDQNYVCKHTYVDRGWGNGCGLFGKGSLVTCAKFQCLEPIEGKVVQYENLKYTVIITVHTGDQHQVGNETQGVTAEITPQASTTEATLPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDAPCKIPFSTEDGHGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSASRAWNVWEVEDYGFGVFTTNIWLRLREVYTQLCDHRLMSAAVKDERAVHADMGYWIESQKNGSWKLEKASLIEVKTCTWPKSHTLWSNGVLESDMIIPKSLAGPISQHNHRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGKVDNFTMGVLCLAILFEEVMRGKFGKKHMIAGVFFTFVLLLSGQITWRNMAHTLIMIGSNASDRMGMGVTYLALIATFKIQPFLALGFFLRKLTSRENLLLGVGLAMATTLQLPEDIEQMANGIALGLMALKLITQFETYQLWTALISLTCSNTIFTLTVAWRTATLILAGVSLLPVCQSSSMRKTDWLPMAVAAMGVPPLPLFIFSLKDTLKRRSWPLNEGVMAVGLVSILASSLLRNDVPMAGPLVAGGLLIACYVITGTSADLTVEKAADITWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTYNGKRLEPNWASVKKDLISYGGGWRLSTQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKDFAAGRKSIALDLVTEIGRVPSHLAHRTRNALDNLVMLHTSEHGGRAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKEFDLYKRSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVASVNMVSRLLLNRFTMTHRRPTIEKDVDLGAGTRHVNAEPETPNMDVIGERIKRIKEEHNSTWHYDEENPYKTWAYHGSYEVKATGSASSMINGVVKLLTKPWDVVPMVTQMAMTDTTPFGQQRVFKEKVDTRTPRSMPGTRRVMGITAEWLWRTLGRNKKPRLCTREEFTKKVRTNAAMGAVFTEENQWDSAKAAVEDEDFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPTGTVMDIISRKDQRGSGQVGTYGLNTFTNMEAQLIRQMEGEGVLSKADLENPHLPEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLRETACLGKAYAQMWSLMYFHRRDLRLASNAICSAVPVHWVPTSRTTWSIHAHHQWMTTEDMLTVWNRVWIEDNPWMEDKTPVTTWEDVPYLGKREDQWCGSLIGLTSRATWAQNIPTAIQQVRSLIGNEEFLDYMPSMKRFRKEEESEGAIW

SEQ ID NO: 4835 - protein, 3290 aa, Artificial Sequence
  derived and/or modified protein sequence (wt) from DENV-3__KJ189291__SS-prME
TSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAVLPEEQDQNYVCKHTYVDRGWGNGCGLFGKGSLVTCAKFQCLEPIEGKVVQYENLKYTVIITVHTGDQHQVGNETQGVTAEITPQASTTEATLPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDAPCKIPFSTEDGHGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSASRAWNVWEVEDYGFGVFTTNIWLRLREVYTQLCDHRLMSAAVKDERAVHADMGYWIESQKNGSWKLEKASLIEVKTCTWPKSHTLWSNGVLESDMIIPKSLAGPISQHNHRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGKVDNFTMGVLCLAILFEEVMRGKFGKKHMIAGVFFTFVLLLSGQITWRNMAHTLIMIGSNASDRMGMGVTYLALIATFKIQPFLALGFFLRKLTSRENLLLGVGLAMATTLQLPEDIEQMANGIALGLMALKLITQFETYQLWTALISLTCSNTIFTLTVAWRTATLILAGVSLLPVCQSSSMRKTDWLPMAVAAMGVPPLPLFIFSLKDTLKRRSWPLNEGVMAVGLVSILASSLLRNDVPMAGPLVAGGLLIACYVITGTSADLTVEKAADITWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTYNGKRLEPNWASVKKDLISYGGGWRLSTQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKDFAAGRKSIALDLVTEIGRVPSHLAHRTRNALDNLVMLHTSEHGGRAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKEFDLYKRSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVASVNMVSRLLLNRFTMTHRRPTIEKDVDLGAGTRHVNAEPETPNMDVIGERIKRIKEEHNSTWHYDEENPYKTWAYHGSYEVKATGSASSMINGVVKLLTKPWDVVPMVTQMAMTDTTPFGQQRVFKEKVDTRTPRSMPGTRRVMGITAEWLWRTLGRNKKPRLCTREEFTKKVRTNAAMGAVFTEENQWDSAKAAVEDEDFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPTGTVMDIISRKDQRGSGQVGTYGLNTFTNMEAQLIRQMEGEGVLSKADLENPHLPEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLRETACLGKAYAQMWTLMYFHRRDLRLASNAICSAVPVHWVPTSRTTWSIHAHHQWMTTEDMLTVWNRVWIEDNPWMEDKTPVTTWEDVPYLGKREDQWCGSLIGLTSRATWAQNIPTAIQQVRSLIGNEEFLDYMPSMKRFRKEEESEGAIW

SEQ ID NO: 4836 - protein, 3290 aa, Artificial Sequence
  derived and/or modified protein sequence (wt) from DENV-3__KJ189292__SS-prME
TSLCLMMILPAALAFHLTSRDGEPRMIVGKNERGKSLLFKTASGINMCTLIAMDLGEMCDDTVTYKCPHITEAEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAVLPEEQDQNYVCKHTYVDRGWGNGCGLFGKGSLVTCAKFQCLEPIEGKVVQYENLKYTVIITVHTGDQHQVGNETQGVTAEITPQASTTEATLPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDAPCKIPFSTEDGHGKAHNGRLITANPVVTKKEEPVNIEAEPPFGESNIMIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQADMGCIINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSASRAWNVWEVEDYGFGVFTTNIWLRLREVYTQLCDHRLMSAAVKDERAVHADMGYWIESQKNGSWKLEKASLIEVKTCTWPKSHTLWSNGVLESDMIIPKSLAGPISQHNHRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGKVDNFTMGVLCLAILFEEVMRGKFGKKHMIAGVFFTFVLLLSGQITWRDMAHTLIMIGSNASDRMGMGVTYLALIATFKIQPFLALGFFLRKLTSRENLLLGVGLAMATTLQLPEDIEQMANGIALGLMALKLITQFETYQLWTALISLTCSNTIFTLTVAWRTATLILAGVSLLPVCQSSSMRKTDWLPMAVAAMGVPPLPLFIFSLKDTLKRRSWPLNEGVMAVGLVSILASSLLRNDVPMAGPLVAGGLLIACYVITGTSADLTVEKAADITWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTYNGKRLEPNWASVKKDLISYGGGWRLSTQWQKGEEVQVIAVEPGKNPKNFQTIPGTFQTTTGEIGAIALDFKPGTSGSPIINREGKVVGLYGNGVVTKNGGYVSGIAQTNAEPDGSTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTVASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKDFAAGRKSIALDLVTEIGRVPSHLAHRTRNALDNLVMLHTSEHGGRAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVASVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRSMPGTRRVMGITAEWLWRTLGRNKKPRLCTREEFTKKVRTNAAMGAVFTEENQWDSAKAAVEDEDFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPTGTVMDIISRKDQRGSGQVGTYGLNTFTNMEVQLIRQMEGEGVLSKADLENPHLPEKKITQWLETKGVERLKRMAISGDDCVVKPIDDRFANALLALNDMGKIRKDIPQWQPSKGWHDWQQVPFCSHHFHELIMKDGRKLVVPCRPQDELIGRARISQGAGWSLRETACLGKAYAQMWSLMYFHRRDLRLASNAICSAVPVHWVPTSRTTWSIHAHHQWMTTEDMLTVWNRVWIEDNPWMEDKTPVTTWEDVPYLGKREDQWCGSLIGLTSRATWAQNIPTAIQQVRSLIGNEEFLDYMPSMKRFRKEEESEGAIW

SEQ ID NO: 4837 - protein, 3290 aa, Artificial Sequence
  derived and/or modified protein sequence (wt) from DENV-3__KJ189293__SS-prME
TSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAVLPEEQDQNYVCKHTYVDRGWGNGCGLFGKGSLVTCAKFQCLEPIEGKVVQYENLKYTVIITVHTGDQHQVGNETQGVTAEITPQASTTEATLPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDAPCKIPFSTEDGHGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSASRAWNVWEVEDYGFGVFTTNIWLRLREVYTQLCDHRLMSAAVKDERAVHADMGYWIESQKNGSWKLEKASLIEVKTCTWPKSHTLWSNGVLESDMIIPKSLAGPISQHNHRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGKVDNFTMGVLCLAILFEEVMRGKFGKKHMIAGVFFTFVLLLSGQITWRDMAHTLIMIGSNASDRMGMGVTYLALIATFKIQPFLALGFFLRKLTSRENLLLGVGLAMATTLQLPEDIEQMANGIALGLMALKLITQFETYQLWTALISLTCSNTIFTLTVAWRTATLILAGVSLLPVCQSSSMRKTDWLPMAVAAMGVPPLPLFIFSLKDTLKRRSWPLNEGVMAVGLVSILASSLLRNDVPMAGPLVAGGLLIACYVITGTSADLTVEKAADITWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTYNGKRLEPNWASVKKDLISYGGGWRLSTQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKDFAAGRKSIALDLVTEIGRVPSHLAHRTRNALDNLVMLHTSEHGGRAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVASVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRSMPGTRRVMGITAEWLWRTLGRNKKPRLCTREEFTKKVRTNAAMGAVFTEENQWDSAKAAVEDEDFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPTGTVMDIISRKDQRGSGQVGTYGLNTFTNMEAQLIRQMEGEGVLSKADLENPHLPEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLRETACLGKAYAQMWSLMYFHRRDLRLASNAICSAVPVHWVPTSRTTWSIHAHHQWMTTEDMLTVWNRVWIEDNPWMEDKTPVTTWEDVPYLGKREDQWCGSLIGLTSRATWAQNIPTAIQQVRSLIGNEEFLDYMPSMKRFRKEEESEGAIW

SEQ ID NO: 4838 - protein, 3290 aa, Artificial Sequence
  derived and/or modified protein sequence (wt) from DENV-3__KJ189294__SS-prME
TSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAVLPEEQDQNYVCKHTYVDRGWGNGCGLFGKGSLVTCAKFQCLEPIEGKVVQYENLKYTVIITVHTGDQHQVGNETQGVTAEITPQASTTEATLPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDAPCKIPFSTEDGHGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDIIGILEQGKRTLTPQPMELKYSWKTWGKAKIVTAETQNSSFIIDGPNTPECPSASRAWNVWEVEDYGFGVFTTNIWLRLREVYTQLCDHRLMSAAVKDERAVHADMGYWIESQKNGSWKLEKASLIEVKTCTWPKSHTLWSNGVLESDMIIPKSLAGPISQHNHRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGKVDNFTMGVLCLAILFEEVMRGKFGKKHMIAGVFFTFVLLLSGQITWRDMAHTLIMIGSNASDRMGMGVTYLALIATFKIQPFLALGFFLRKLTSRENLLLGVGLAMATTLQLPEDIEQMANGIALGLMALKLITQFETYQLWTALISLTCSNTIFTLTVAWRTATLILAGVSLLPVCQSSSMRKTDWLPMAVAAMGVPPLPLFIFSLKDTLKRRSWPLNEGVMAVGLVSILASSLLRNDVPMAGPLVAGGLLIACYVITGTSADLTVEKAADITWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTYNGKRLEPNWASVKKDLISYGGGWRLSTQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKDFAAGRKSIALDLVTEIGRVPSHLAHRTRNALDNLVMLHTSEHGGRAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVASVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRSMPGTRRVMGITAEWLWRTLGRNKKPRLCTREEFTKKVRTNAAMGAVFTEENQWDSAKAAVEDEDFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPTGTVMDIISRKDQRGSGQVGTYGLNTFTNMEAQLIRQMEGEGVLSKADLENPHLPEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLRETACLGKAYAQMWSLMYFHRRDLRLASNAICSAVPVHWVPTSRTTWSIHAHHQWMTTEDMLTVWNRVWIEDNPWMEDKTPVTTWEDVPYLGKREDQWCGSLIGLTSRATWAQNIPTAIQQVRSLIGNEEFLDYMPSMKRFRKEEESEGAIW

SEQ ID NO: 4839 - protein, 3290 aa, Artificial Sequence
  derived and/or modified protein sequence (wt) from DENV-3__KJ189295__SS-prME
TSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAVLPEEQDQNYVCKHTYVDRGWGNGCGLFGKGSLVTCAKFQCLEPIEGKVVQYENLKYTVIITVHTGDQHQVGNETQGVTAEITPQASTTEATLPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDAPCKIPFSTEDGHGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSASRAWNVWEVEDYGFGVFTTNIWLRLREVYTQLCDHRLMSAAVKDERAVHADMGYWIESQKNGSWKLEKASLIEVKTCTWPKSHTLWSNGVLESDMIIPKSLAGPISQHNHRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGKVDNFTMGVLCLAILFEEVMRGKFGKKHMIAGVFFTFVLLLSGQITWRDMAHTLIMIGSNASDRMGMGVTYLALIATFKIQPFLALGFFLRKLTSRENLLLGVGLAMATTLQLPEDIEQMANGIALGLMALKLITQFETYQLWTALISLTCSNTIFTLTVAWRTATLILAGVSLLPVCQSSSMRKTDWLPMAVAAMGVPPLPLFIFSLKDTLKRRSWPLNEGVMAVGLVSILASSLLRNDVPMAGPLVAGGLLIACYVITGTSADLTVEKAADITWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTYNGKRLEPNWASVKKDLISYGGGWRLSTQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKDFAAGRKSIALDLVTEIGRVPSHLAHRTRNALDNLVMLHTSEHGGRAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVASVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRSMPGTRRVMGITAEWLWRTLGRNKKPRLCTREEFTKKVRTNAAMGAVFTEENQWDSAKAAVEDEDFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPTGTVMDIISRKDQRGSGQVGTYGLNTFTNMEAQLIRQMEGEGVLLKADLENPHLPEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLRETACLGKAYAQMWSLMYFHRRDLRLASNAICSAVPVHWVPTSRTTWSIHAHHQWMTTEDMLTVWNRVWIEDNPWMEDRTPVTTWEDVPYLGKREDQWCGSLIGLTSRATWAQNIPTAIQQVRSLIGNEEFLDYMPSMKRFRKEEESEGAIW

SEQ ID NO: 4840 - protein, 3290 aa, Artificial Sequence
  derived and/or modified protein sequence (wt) from DENV-3__KJ189297__SS-prME
TSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAVLPEEQDQNYVCKHTYVDRGWGNGCGLFGKGSLVTCAKFQCLEPIEGKVVQYENLKYTVIITVHTGDQHQVGNETQGVTAEITPQASTTEATLPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDAPCKIPFSTEDGHGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSASRAWNVWEVEDYGFGVFTTNIWLRLREVYTQLCDHRLMSAAVKDERAVHADMGYWIESQKNGSWKLEKASLIEVKTCTWPKSHTLWSNGVLESDMIIPKSLAGPISQHNHRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGKVDNFTMGVLCLAILFEEVMRGKFGKKHMIAGVFFTFVLLLSGQITWRDMAHTLIMIGSNASDRMGMGVTYLALIATFKIQPFLALGFFLRKLTSRENLLLGVGLAMATTLQLPEDIEQMANGIALGLMALKLITQFETYQLWTALISLTCSNTIFTLTVAWRTATLILAGVSLLPVCQSSSMRKTDWLPMAVAAMGVPPLPLFIFSLKDTLKRRSWPLNEGVMAVGLVSILASSLLRNDVPMAGPLVAGGLLIACYVITGTSADLTVEKAADITWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTYNGKRLEPNWASVKKDLISYGGGWRLSTQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKDFAAGRKSIALDLVTEIGRVPSHLAHRTRNALDNLVMLHTSEHGGRAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVASVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRSMPGTRRVMGITAEWLWRTLGRNKKPRLCTREEFTKKVRTNAAMGAVFTEENQWDSAKAAVEDEDFWKLVDRERELHKLGKCGSCVYNMMGKREKKLGEFGKAKGSRAIWYMWLGARYLEFEALGFLNEDHWFSRENSYSGVEGEGLHKLGYILRDISQIPGGAMYADDTAGWDTRITEDDLHNEEKITQQMDPEHRQLANAIFKLTYQNKVVKVQRPTPTGTVMDIISRKDQRGSGQVGTYGLNTFTNMEAQLIRQMEGEGVLSKADLENPHLPEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLRETACLGKAYAQMWSLMYFHRRDLRLASNAICSAVPVHWVPTSRTTWSIHAHHQWMTTEDMLTVWNRVWIEDNPWMEDKTPVTTWEDVPYLGKREDQWCGSLIGLTSRATWAQNIPTAIQQVRSLIGNEEFLDYMPSMKRFRKEEESEGAIW

SEQ ID NO: 4841 - protein, 3290 aa, Artificial Sequence
  derived and/or modified protein sequence (wt) from DENV-3__KJ189298__SS-prME
TSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAVLPEEQDQNYVCKHTYVDRGWGNGCGLFGKGSLVTCAKFQCLEPIEGKVVQYENLKYTVIITVHTGDQHQVGNETQGVTAEITPQASTTEATLPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDAPCKIPFSTEDGHGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSASRAWNVWEVEDYGFGVFTTNIWLRLREVYTQLCDHRLMSAAVKDERAVHADMGYWIESQKNGSWKLEKASLIEVKTCTWPKSHTLWSNGVLESDMIIPKSLAGPISQHNHRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGKVDNFTMGVLCLAILFEEVMRGKFGKKHMIAGVFFTFVLLLSGQITWRNMAHTLIMIGSNASDRMGMGVTYLALIATFKIQPFLALGFFLRKLTSRENLLLGVGLAMATTLQLPEDIEQMANGIALGLMALKLITQFETYQLWTALISLTCSNTIFTLTVAWRTATLILAGVSLLPVCQSSSMRKTDWLPMAVAAMGVPPLPLFIFSLKDTLKRRSWPLNEGVMAVGLVSILASSLLRNDVPMAGPLVAGGLLIACYVITGTSADLTVEKAADITWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTYNGKRLEPNWASVKKDLISYGGGWRLSTQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKDFAAGRKSIALDLVTEIGRVPSHLAHRTRNALDNLVMLHTSEHGGRAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVASVNMVSRLLLNRFTMTHRRPTIEKDVDLGAGTRHVNAEPETPNMDVIGERIKRIKEEHNSTWHYDEENPYKTWAYHGSYEVKATGSASSMINGVVKLLTKPWDVVPMVTQMAMTDTTPFGQQRVFKEKVDTRTPRSMPGTRRVMGITAEWLWRTLGRNKKPRLCTREEFTKKVRTNAAMGAVFTEENQWDSAKAAVEDEDFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPTGTVMDIISRKDQRGSGQVGTYGLNTFTNMEAQLIRQMEGEGVLSKADLENPHLPEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLRETACLGKAYAQMWSLMYFHRRDLRLASNAICSAVPVHWVPTSRTTWSIHAHHQWMTTEDMLTVWNRVWIEDNPWMEDKTPVTTWEDVPYLGKREDQWCGSLIGLTSRATWAQNIPTAIQQVRSLIGNEEFLDYMPSMKRFRKEEESEGAIW

SEQ ID NO: 4842 - protein, 3290 aa, Artificial Sequence
  derived and/or modified protein sequence (wt) from DENV-3__KJ189301__SS-prME
TSLCLMMILPAALAFHLTSRDGEPRMIVGKNERGKSLLFKTASGTNMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAVLPEEQDQNYVCKHTYVDRGWGNGCGLFGKGSLVTCAKFQCLEPIEGKVVQYENLKYTVIITVHTGDQHQVGNETQGVTAEITPQASTTEATLPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDAPCKIPFSTEDGHGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQADMGCVINWKGKELKCGSGIFVTNEVHTWTEQYKFQADSPKRLATAIAGAWENGVCGIRSTTRMENLLWKQIANELNYILWENNVKLTVVVGDIIGVLERGKRTLTPQPMELKYSWKTWGKAKIVTAETQNSSFIIDGPNTPECPSASRAWNVWEVEDYGFGVFTTNIWLRLREAYTQLCDHRLMSAAVKDERAVHADMGYWIESQKNGSWKLEKASLIEVKTCTWPKSHTLWSNGVLESDMIIPKSLAGPISQHNHRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGKVDNFTMGVLCLAILFEEVMRGKFGKKHMIAGVFFTFVLLLSGQITWRDMAHTLIMIGSNASDRMGMGVTYLALIATFKIQPFLALGFFLRKLTSRENLLLGVGLAMATTLQLPEDIEQMANGIALGLMALKLITQFETYQLWTALISLTCSNTIFTLTVAWRTATLILAGVSLLPVCQSSSMRKTDWLPMAVAAMGVPPLPLFIFSLKDTLKRRSWPLNEGVMAVGLVSILASSLLRNDVPMAGPLVAGGLLIACYVITGTSADLTVEKAADITWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTYNGKRLEPNWASVKKDLISYGGGWRLSTQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKDFAAGRKSIALDLVTEIGRVPSHLAHRTRNALDNLVMLHTSEHGGRAYRHAVEELPETMETLLLLGLMILLTGGAMLFLISGKGIGKTSIGLICVIASSGMLWMAEIPLQWIASAIVLEFFMMVLLVPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVASVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRSMPGTRRVMGITAEWLWRTLGRNKKPRLCTREEFTKKVRTNAAMGAVFTEENQWDSAKAAVEDEDFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPTGTVMDIISRKDQRGSGQVGTYGLNTFTNMEAQLIRQMEGEGVLSKADLENPHLPEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLRETACLGKAYAQMWSLMYFHRRDLRLASNAICSAVPVHWVPTSRTTWSIHAHHQWMTTEDMLTVWNRVWIEDNPWMEDKTPVTTWEDVPYLGKREDQWCGSLIGLTSRATWAQNIPTAIQQVRSLIGNEEFLDYMPSMKRFRKEEESEGAIW

SEQ ID NO: 4843 - protein, 3290 aa, Artificial Sequence
  derived and/or modified protein sequence (wt) from DENV-3__KF955456__SS-prME
TSLCLMMILPAALAFHLTSRDGEPRMIVGKNERGKSLLFKTASGINMCTLIAMDLGEMCDDTVTYKCPHIAEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFVLLMLVTPSMTMRCVGVGNRDFVEGLSGATWVDVVLEHGGCVTTMAKNKPTLDIELQKTEATQLATLRKLCIEGKITNITTDSRCPTQGEAVLPEEQDQNYVCKHTYVDRGWGNGCGLFGKGSLVTCAKFQCLEPIEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDAPCKIPFSTEDGQGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQADTGCVINWKGKELKCGSGIFVTNEVHTWTEQYKFQADSPKRLATAIAGAWENGVCGIRSTTRMENLLWKQVANELNYILWENNIKLTVVVGDIIGVLEQGKRTLTPQPMELKYSWKTWGKAKIVTAETQNSSFIIDGPNTPECPSASRAWNVWEVEDYGFGVFTTNIWLKLREVYTQLCDHRLMSAAVKDERAVHADMGYWIESQKNGSWKLEKASLIEVKTCTWPKSHTLWSNGVLESDMIIPKSLAGPISQHNYRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGKVDNFTMGVLCLAILFEEVMRGKFGKKHMIAGVFFTFVLLLSGQITWRDMAHTLVMIGSNASDRMGMGVTYLALIATFKIQPFLALGFFLRKLTSRENLLLGVGLAMATTLQLPEDIEQMANGIALGLMALKLITQFETYQLWTALISLTCSNTIFTLTVAWRTATLILAGVSLLPVCQSSSMRKSDWLPMTVAAMGVPPLPLFIFSLKDTLKRRSWPLNEGVMAVGLVSILASSLLRNDVPMAGPLVAGGLLIACYVITGTSADLTVEKAADVTWEEEAEQTGVSHNLMITVDDDGTMRIKDDETENILTVLLKTALLIVSGIFPYSIPATLLVWHTWQKQTRRSGVLWDVPSPPETQKAELEEGVYRIKQQGIFGKTQVGVGVQKEGVFHTMWHVTRGAVLTYNGKRLEPNWASVKKDLISYGGGWRLSAQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKDFAAGRKSIALDLVTEIGRVPSHLAHRTRNALDNLVMLHTSEHGGKAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAIQLLLMRTSWALCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKYGGMLVRNPLSRNSTHEMYWISNGTGNIVASVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRSMPGTRRVMGITAEWLWRTLGRNKKPRLCTREEFTKKVRTNAAMGAVFTEENQWDSAKAAVEDEDFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPTGTVMDIISRKDQRGSGQVGTYGLNTFTNMEAQLIRQMEGEGVLTKADLENPHLSEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLRETACLGKAYAQMWSLMYFHRRDLRLASNAICSAVPVHWVPTSRTTWSIHAHHQWMTTEDMLTVWNRVWIEDNPWMEDKTPVTTWENVPYLGKREDQWCGSLIGLTSRATWAQNIPTAIQQVRSLIGNEEFLDYMPSMKRFRKEEESEGAIW

SEQ ID NO: 4844 - protein, 3290 aa, Artificial Sequence
  derived and/or modified protein sequence (wt) from DENV-3__KF955465__SS-prME
TSLCIMMILPAALAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAVLPEEQDQNYVCKHTYVDRGWGNGCGLFGKGSLVTCAKFQCLEPIEGKVVQYENLKYTVIITVHTGDQHQVGNETQGVTAEITPQASTTEAILPEYGTLGLECSPRTGLDFNEMVLLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDVPCKIPFSTEDGQGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIVIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSASRAWNVWEVEDYGFGVFTTNIWLKLREVYTQLCDHRLMSAAVKDERAVHADMGYWIESQKNGSWKLEKASLIEVKTCTWPKSHTLWSNGVLESDMIIPKSLAGPISQHNYRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGKVDNFTMGVLCLAILFEEVMRGKFGKKHMIAGVFFTFVLLLSGQITWRDMAHTLIMIGSNASDRMGMGVTYLALIATFKIQPFLALGFFLRKLTSRENLLLGVGLAMATTLQLPEDIEQMANGIALGLMALKLITQFETYQLWTALISLTCSNTIFTLTVAWRTATLILAGVSLLPVCQSSSMRKTDWLPMTVAAMGVPPLPLFIFSLKDTLKRRSWPLNEGVMAVGLVSILASSLLRNDVPMAGPLVAGGLLIACYVITGTSADLTVEKAADVTWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTYNGKRLEPNWASVKKDLISYGGGWRLSAQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKDFAAGRKSIALDLVTEIGRVPSHLAHRTRNALDNLVMLHTSEHGGKAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVASVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRSMPGTRRVMGITAEWLWRTLGRNKKPRLCTREEFTKKVRTNAAMGAVFTEENQWDSAKAAVEDEDFWILVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPTGTVMDIISRKDQRGSGQVGTYGLNTFTNMEAQLIRQMEGEGVLSKADLENPHLPEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLRETACLGKAYAQMWSLMYFHRRDLRLASNAICSAVPVHWVPTSRTTWSIHAHHQWMTTEDMLTVWNRVWIEDNPWMEDKTPVTTWENVPYLGKREDQWCGSLIGLTSRATWAQNIPTAIQQVRSLIGNEEFLDYMPSMKRFRKEEESEGAIW

SEQ ID NO: 4845 - protein, 3290 aa, Artificial Sequence
  derived and/or modified protein sequence (wt) from DENV-3__KF955466__SS-prME
TSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAVLPEEQDQNYVCKHTYVDRGWGNGCGLFGKGSLVTCAKFQCLEPIEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDVPCKIPFSTEDGQGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIVIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSASRAWNVWEVEDYGFGVFTTNIWLKLREVYTQLCDHRLMSAAVKDERAVHADMGYWIESQKNGSWKLEKASLIEVKTCTWPKSHTLWSNGVLESDMIIPKSLAGPISQHNYRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGKVDNFTMGVLCLAILFEEVMRGKFGKKHMIAGVFFTFVLLLSGQITWRDMAHTLIMIGSNASDRMGMGVTYLALIATFKIQPFLALGFFLRKLTSRENLLLGVGLAMATTLQLPEDIEQMANGIALGLMALKLITQFETYQLWTALISLTCSNTIFTLTVAWRTATLILAGVSLLPVCQSSSMRKTDWLPMTVAAMGVPPLPLFIFSLKDTLKRRSWPLNEGVMAVGLVSILASSLLRNDVPMAGPLVAGGLLIACYVITGTSADLTVEKAADVTWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTYNGKRLEPNWASVKKDLISYGGGWRLSAQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKDFAAGRKSIALDLVTEIGRVPSHLAHRTRNALDNLVMLHTSEHGGKAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVASVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRSMPGTRRVMGITAEWLWRTLGRNKKPRLCTREEFTKKVRTNAAMGAVFTEENQWDSAKAAVEDEDFWMLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPTGTVMDIISRKDQRGSGQVGTYGLNTFTNMEAQLIRQMEGEGVLSKADLENPHLPEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLRETACLGKAYAQMWSLMYFHRRDLRLASNAICSAVPVHWVPTSRTTWSIHAHHQWMTTEDMLTVWNRVWIEDNPWMEDKTPVTTWENVPYLGKREDQWCGSLIGLTSRATWAQNIPTAIQQVRSLIGNEEFLDYMPSMKRFRKEEESEGAIW

SEQ ID NO: 4846 - protein, 3290 aa, Artificial Sequence
  derived and/or modified protein sequence (wt) from DENV-3__KF955468__SS-prME
TSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAVLPEEQDQNYVCKHTYVDRGWGNGCGLFGKGSLVTCAKFQCLEPIEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDVPCKIPFSTEDGQGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIVIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSASRAWNVWEVEDYGFGVFTTNIWLKLREVYTQLCDHRLMSAAVKDERAVHADMGYWIESQKNGSWKLEKASLIEVKTCTWPKSHTLWSNGVLESDMIIPKSLAGPISQHNYRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGKVDNFTMGVLCLAILFEEVMRGKFGKKHMIAGVFFTFVLLLSGQITWRDMAHTLIMIGSNASDRMGMGVTYLALIATFKIQPFLALGFFLRKLTSRENLLLGVGLAMATTLQLPEDIEQMANGIALGLMALKLITQFETYQLWTALISLTCSNTILTLTVAWRTATLILAGVSLLPVCQSSSMRKTDWLPMTVAAMGVPPLPLFIFSLKDTLKRRSWPLNEGVMAVGLVSILASSLLRNDVPMAGPLVAGGLLIACYVITGTSADLTVEKAADVTWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTYNGKRLEPNWASVKKDLISYGGGWRLSAQWQKGEEVQVIAVEPGKNPKNFQTMPGTFQTTTGEIGAIALDFKPGTSGSPIINREGRVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKDFAAGRKSIALDLVTEIGRVPSHLAHRTRNALDNLVMLHTSEHGGKAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVASVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRSMPGTRRVMGITAEWLWRTLGRNKKPRLCTREEFTKKVRTNAAMGAVFTEENQWDSAKAAVEDEDFWTLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPTGTVMDIISRKDQRGSGQVGTYGLNTFTNMEAQLIRQMEGEGVLSKADLENPHLPEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLRETACLGKAYAQMWSLMYFHRRDLRLASNAICSAVPVHWVPTSRTTWSIHAHHQWMTTEDMLTVWNRVWIEDNPWMEDKTPVTTWENVPYLGKREDQWCGSLIGLTSRATWAQNIPTAIQQVRSLIGNEEFLDYMPSMKRFRKEEESEGAIW

SEQ ID NO: 4847 - protein, 3290 aa, Artificial Sequence
  derived and/or modified protein sequence (wt) from DENV-3__FJ744726__SS-prME
TSLCLMMMLPATLAFHLTSRDGEPRMIVAKNERGKSLLFKTASGINMCTLIAMDLGEMCDDTVTYKCPLIAEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAILPEEQDQNYVCKHTYVDRGWGNGCGLFGKGSLVTCAKFQCLEPIEGKVVQHENLKYTVIITVHTGDQHQVGNDTQGVTVEITPQASTVEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCLNTFVLKKEVSETQHGTILIKVEYKGEDAPCKIPFSTEDGQGKAHNGRLITANPVVTKKEEPVNIEAEPPFGESNIVIGIGDKALKINWYKKGSSIGKMFEATARGARRMAILGDTAWDFGSVGGVLNSLGKMVHQIFGSAYTALFSGVSWIMKIGIGVLLTWIGLNSKNTSMSFSCIVIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSASRAWNVWEVEDYGFGVFTTNIWLKLREVYTQSCDHRLMSAAIKDERAVHADMGYWIESQKNGSWKLEKASFIEVKTCTWPKSHTLWSNGVLESDMIIPKSLAGPISQHNHRPGYHTQTAGPWHLGKLELDFNYCEGTTVVITENCGTRGPSLRTTTVSGKLIHEWCCRSCTLPPLRYMGEDGCWYGMEIRPINEKEENMVKSLVSAGSGKMDNFTMGILCLAILFEEVMRGKFGKKHMIAGVLFTFVLLLSGQITWRDMAHTLIMIGSNASDRMGMGVTYLALIATFKIQPFLALGFFLRKLTSRENLLLGVGLAMATTLQLPEDIEQMANGIALGLMTLKLITQFETYQLWTALVSLTCSNTIFTLTVAWRTATLILAGVSLLPLCQSSSMRKTDWLPMTVAAMGVPPLPLFIFSLKDTPKRRSWPLNEGVMAVGLVSILASSLLRNDVPMAGPLVAGGLLIACYVITGTSADLTVEKAADVTWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTHNGKRLEPNWASVKKDLISYGGGWRLSAQWQKGEEVQVIAVEPGKNPKNFQTMPGIFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTAIKSEHTGREIVDLMCHATFTMRLLSPVRVPNYNLIIMDEAHFTDPASIAARGYISTRVGMGEAAAIFMTATPPGTAEAFPQSNAPIQDEEKDIPERSWNSGNEWITDFVGKTVWFVPSIKAGNDIANCLRKNGKKVIQLSRKTFDTEYQKTRLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGERNNQILEENMDVEIWTKEGERKKLRPRWLDARTYSDPLALKEFKDFAAGRKSIALDLVTEIGRVPSHLAHRTRNALDNLVMLHTSEHGGRAYRHAVEELPETMETLLLLGLMILLTGGAMLFLISGKGIGKTSIGLICVIVSSGMLWMADVPLQWIASAIVLEFFMMVLLIPEPEKQRTPQDNQLAYVVIGILTLAAIVTANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLVTHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGETTHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVSSVNMVSRLLLNRFTMTHRRPTIEKDVDLGAGTRHVNAEPETPNMDVIGERIKRIKEEHSSTWHYDDENPYKTWAYHGSYEVKATGSASSMINGVVKLLTKPWDVVPMVTQMAMTDTTPFGQQRVFKEKVDTRTPRPMPGTRKVMEITAEWLWRTLGRNKRPRLCTREEFTKKVRTNAAMGAVFTEENQWDSARAAVEDEEFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPKGTVMDIISRKDQRGSGQVGTYGLNTFTNMEAQLVRQMEGEGVLSKVDLENPHLLEKKITQWLETKGVERLRRMAISGDDCVVKPIDDRFANALLALNDMGKVRKDIPQWQPSKGWHDWQQVPFCSHHFHELIMKDGRKLVVPCRPQDELIGRARISQGAGWSLKETACLGKAYAQMWSLMYFHRRDLRLASNAICSAVPVHWVPTSRTTWSIHAHHQWMTTEDMLTVWNRVWIEDNPWMEDKTPVTTWEDVPYLGKREDQWCGSLIGLTSRATWAQNILTAIQQVRSLIGDEEFLDYMPSMKRFRKEEESEGAIW

SEQ ID NO: 4848 - protein, 3290 aa, Artificial Sequence
  derived and/or modified protein sequence (wt) from DENV-3__FJ744729__SS-prME
TSLCLMMMLPATLAFHLTSRDGEPRMIVAKNERGKSLLFKTASGINMCTLIAMDLGEMCDDTVTYKCPLIAEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAILPEEQDQNYVCKHTYVDRGWGNGCGLFGKGSLVTCAKFQCLKPIEGKVVQHENLKYTVIITVHTGDQHQVGNDTQGVTVEITPQASTVEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCLNTFVLKKEVSETQHGTILIKVEYKGEDAPCKIPFSTEDGQGKAHNGRLITANPVVTKKEEPVNIEAEPPFGESNIVIGIGDKALKINWYKKGSSIGKMFEATARGARRMAILGDTAWDFGSVGGVLNSLGKMVHQIFGSAYTALFSGVSWIMKIGIGVLLTWIGLNSKNTSMSFSCIVIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSASRAWNVWEVEDYGFGVFTTNIWLKLREVYTQSCDHRLMSAAIKDERAVHADMGYWIESQKNGSWKLEKASFIEVKTCTWPKSHTLWSNGVLESDMIIPKSLAGPISQHNHRPGYHTQTAGPWHLGKLELDFNYCEGTTVVITENCGTRGPSLRTTTVSGKLIHEWCCRSCTLPPLRYMGEDGCWYGMEIRPINEKEENMVKSLVSAGSGKMDNFTMGILCLAILFEEVMRGKFGKKHMIAGVLFTFVLLLSGQITWRDMAHTLIMIGSNASDRMGMGVTYLALIATFKIQPFLALGFFLRKLTSRENLLLGVGLAMATTLQLPEDIEQMANGIALGLMTLKLITQFETYQLWTALVSLTCSNTIFTLTVAWRTATLILAGVSLLPLCQSSSMRKTDWLPMTVAAMGVPPLPLFIFSLKDTPKRRSWPLNEGVMAVGLVSILASSLLRNDVPMAGPLVAGGLLIACYVITGTSADLTVEKAADVTWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTHNGKRLEPNWASVKKDLISYGGGWRLSAQWQKGEEVQVIAVEPGKNPKNFQTMPGIFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTAIKSEHTGREIVDLMCHATFTMRLLSPVRVPNYNLIIMDEAHFTDPASIAARGYISTRVGMGEAAAIFMTATPPGTAEAFPQSNAPIQDEERDIPERSWNSGNEWITDFVGKTVWFVPSIKAGNDIANCLRKNGKKVIQLSRKTFDTEYQKTRLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGERNNQILEENMDVEIWTKEGERKKLRPRWLDARTYSDPLALKEFKDFAAGRKSIALDLVTEIGRVPSHLAHRTRNALDNLVMLHTSEHGGRAYRHAVEELPETMETLLLLGLMILLTGGAMLFLISGKGIGKTSIGLICVIVSSGMLWMADVPLQWIASAIVLEFFMMVLLIPEPEKQRTPQDNQLAYVVIGILTLAAIVTANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLVTHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMRSVGTGKRGTGSQGETLGEKWKKKLNQLSRKEFDLYKKSGITEVDRTEAKEGLKRGETTHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVSSVNMVSRLLLNRFTMTHRRPTIEKDVDLGAGTRHVNAEPETPNMDVIGERIKRIKEEHSSTWHYDDENPYKTWAYHGSYEVKATGSASSMINGVVKLLTKPWDVVPMVTQMAMTDTTPFGQQRVFKEKVDTRTPRPMPGTRKVMEITAEWLWRTLGRNKRPRLCTREEFTKKVRTNAAMGAVFTEENQWDSARAAVEDEEFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPKGTVMDIISRKDQRGSGQVGTYGLNTFTNMEAQLVRQMEGEGVLSKVDLENPHLLEKKITQWLETKGVERLRRMAISGDDCVVKPIDDRFANALLALNDMGKVRKDIPQWQPSKGWHDWQQVPFCSHHFHELIMKDGRKLVVPCRPQDELIGRARISQGAGWSLKETACLGKAYAQMWSLMYFHRRDLRLASNAICSAVPVHWVPTSRTTWSIHAHHQWMTTEDMLTVWNRVWIEDNPWMEDKTPVTTWEDVPYLGKREDQWCGSLIGLTSRATWAQNILTAIQQVRSLIGDEEFLDYMPSMKRFRKEEESEGAIW

SEQ ID NO: 4849 - protein, 3290 aa, Artificial Sequence
  derived and/or modified protein sequence (wt) from DENV-3__FJ687448__SS-prME
TSLCLMMMLPATLAFHLTSRDGEPRMIVAKNERGKSLLFKTASGINMCTLIAMDLGEMCDDTVTYKCPLIAEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAILPEEQDQNYVCKHTYVDRGWGNGCGLFGKGSLVTCAKFQCLEPIEGKVVQHENLKYTVIITVHTGDQHQVGNDTQGVTVEITPQASTVEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCLNTFVLKKEVSETQHGTILIKVEYKGEDAPCKIPFSTEDGQGKAHNGRLITANPVVTKKEEPVNIEAEPPFGESNIVIGIGDKALKINWYKKGSSIGKMFEATARGARRMAILGDTAWDFGSVGGVLNSLGKMVHQIFGSAYTALFSGVSWIMKIGIGVLLTWIGLNSKNTSMSFSCIVIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSASRAWNVWEVEDYGFGVFTTNIWLKLREVYTQSCDHRLMSAAIKDERAVHADMGYWIESQKNGSWKLEKASFIEVKTCTWPKSHTLWSNGVLESDMIIPKSLAGPISQHNHRPGYHTQTAGPWHLGKLELDFNYCEGTTVVITENCGTRGPSLRTTTVSGKLIHEWCCRSCTLPPLRYMGEDGCWYGMEIRPINEKEENMVKSLVSAGSGKMDNFTMGILCLAILFEEVMRGKFGKKHMIAGVLFTFVLLLSGQITWRDMAHTLIMIGSNASDRMGMGVTYLALIATFKIQPFLALGFFLRKLTSRENLLLGVGLAMATTLQLPEDIEQMANGIALGLMTLKLITQFETYQLWTALVSLTCSNTIFTLTVAWRTATLILAGVSLLPLCQSSSMRKTDWLPMTVAAMGVPPLPLFIFSLKDTPKRRSWPLNEGVMAVGLVSILASSLLRNDVPMAGPLVAGGLLIACYVITGTSADLTVEKAADVTWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTHNGKRLEPNWASVKKDLISYGGGWRLSAQWQKGEEVQVIAVEPGKNPKNFQTMPGIFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTAIKSEHTGREIVDLMCHATFTMRLLSPVRVPNYNLIIMDEAHFTDPASIAARGYISTRVGMGEAAAIFMTATPPGTAEAFPQSNAPIQDEERDIPERSWNSGNEWITDFVGKTVWFVPSIKAGNDIANCLRKNGKKVIQLSRKTFDTEYQKTRLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGERNNQILEENMDVEIWTKEGERKKLRPRWLDARTYSDPLALKEFKDFAAGRKSIALDLVTEIGRVPSHLAHRTRNALDNLVMLHTSEHGGRAYRHAVEELPETMETLLLLGLMILLTGGAMLFLISGKGIGKTSIGLICVIVSSGMLWMADVPLQWIASAIVLEFFMMVLLIPEPEKQRTPQDNQLAYVVIGILTLAAIVTANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLVTHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGETTHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVSSVNMVSRLLLNRFTMTHRRPTIEKDVDLGAGTRHVNAEPETPNMDVIGERIKRIKEEHSSTWHYDDENPYKTWAYHGSYEVKATGSASSMINGVVKLLTKPWDVVPMVTQMAMTDTTPFGQQRVFKEKVDTRTPRPMPGTRKVMEITAEWLWRTLGRNKRPRLCTREEFTKKVRTNAAMGAVFTEENQWDSARAAVEDEEFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPKGTVMDIISRKDQRGSGQVGTYGLNTFTNMEAQLVRQMEGEGVLSKVDLENPHLLEKKITQWLETKGVERLRRMAISGDDCVVKPIDDRFANALLALNDMGKVRKDIPQWQPSKGWHDWQQVPFCSHHFHELIMKDGRKLVVPCRPQDELIGRARISQGAGWSLKETACLGKAYAQMWSLMYFHRRDLRLASNAICSAVPVHWVPTSRTTWSIHAHHQWMTTEDMLTVWNRVWIEDNPWMEDKTPVTTWEDVPYLGKREDQWCGSLIGLTSRATWAQNILTAIQQVRSLIGDEEFLDYMPSMKRFRKEEESEGAIW

SEQ ID NO: 4850 - protein, 3290 aa, Artificial Sequence
  derived and/or modified protein sequence (wt) from DENV-3__FJ744732__SS-prME
TSLCLMMMLPATLAFHLTSRDGEPRMIVAKNERGKSLLFKTASGINMCTLIAMDLGEMCDDTVTYKCPLIAEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAILPEEQDQNYVCKHTYVDRGWGNGCGLFGKGSLVTCAKFQCLEPIEGKVVQHENLKYTVIITVHTGDQHQVGNDTQGVTVEITPQASTVEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCLNTFVLKKEVSETQHGTILIKVEYKGEDAPCKIPFSTEDGQGKAHNGRLITANPVVTKKEEPVNIEAEPPFGESNIVIGIGDKALKINWYKKGSSIGKMFEATARGARRMAILGDTAWDFGSVGGVLNSLGKMVHQIFGSAYTALFSGVSWIMKIGIGVLLTWIGLNSKNTSMSFSCIVIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSASRAWNVWEVEDYGFGVFTTNIWLKLREVYTQSCDHRLMSAAIKDERAVHADMGYWIESQKNGSWKLEKASFIEVKTCTWPKSHTLWSNGVLESDMIIPKSLAGPISQHNHRPGYHTQTAGPWHLGKLELDFNYCEGTTVVITENCGTRGPSLRTTTVSGKLIHEWCCRSCTLPPLRYMGEDGCWYGMEIRPINEKEENMVKSLVSAGSGKMDNFTMGILCLAILFEEVMRGKFGKKHMIAGVLFTFVLLLSGQITWRDMAHTLIMIGSNASDRMGMGVTYLALIATFKIQPFLALGFFLRKLTSRENLLLGVGLAMATTLQLPEDIEQMANGIALGLMTLKLITQFETYQLWTALVSLTCSNTIFTLTVAWRTATLILAGVSLLPLCQSSSMRKTDWLPMTVAAMGVPPLPLFIFSLKDTPKRRSWPLNEGVMAVGLVSILASSLLRNDVPMAGPLVAGGLLIACYVITGTSADLTVEKAADVTWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTHNGKRLEPNWASVKKDLISYGGGWRLSAQWQKGEEVQVIAVEPGKNPKNFQTMPGIFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTAIKSEHTGREIVDLMCHATFTMRLLSPVRVPNYNLIIMDEAHFTDPASIAARGYISTRVGMGEAAAIFMTATPPGTAEAFPQSNAPIQDEERDIPERSWNSGNEWITDFAGKTVWFVPSIKAGNDIANCLRKNGKKVIQLSRKTFDTEYQKTRLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGERNNQILEENMDVEIWTKEGERKKLRPRWLDARTYSDPLALKEFKDFAAGRKSIALDLVTEIGRVPSHLAHRTRNALDNLVMLHTSEHGGRAYRHAVEELPETMETLLLLGLMILLTGGAMLFLISGKGIGKTSIGLICVIVSSGMLWMADVPLQWIASAIVLEFFMMVLLIPEPEKQRTPQDNQLAYVVIGILTLAAIVTANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLVTHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGETTHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVSSVNMVSRLLLNRFTMTHRRPTIEKDVDLGAGTRHVNAEPETPNMDVIGERIKRIKEEHSSTWHYDDENPYKTWAYHGSYEVKATGSASSMINGVVKLLTKPWDVVPMVTQMAMTDTTPFGQQRVFKEKVDTRTPRPMPGTRKVMEITAEWLWRTLGRNKRPRLCTREEFTKKVRTNAAMGAVFTEENQWDSARAAVEDEEFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPKGTVMDIISRKDQRGSGQVGTYGLNTFTNMEAQLVRQMEGEGVLSKVDLENPHLLEKKITQWLETKGVERLRRMAISGDDCVVKPIDDRFANALLALNDMGKVRKDIPQWQPSKGWHDWQQVPFCSHHFHELIMKDGRKLVVPCRPQDELIGRARISQGAGWSLKETACLGKAYAQMWSLMYFHRRDLRLASNAICSAVPVHWVPTSRTTWSIHAHHQWMTTEDMLTVWNRVWIEDNPWMEDKTPVTTWEDVPYLGKREDQWCGSLIGLTSRATWAQNILTAIQQVRSLIGDEEFLDYMPSMKRFRKEEESEGAIW

SEQ ID NO: 4851 - protein, 3290 aa, Artificial Sequence
  derived and/or modified protein sequence (wt) from DENV-3__FJ810414__SS-prME
TSLCLMMMLPATLAFHLTSRDGEPRMIVAKNERGKSLLFKTASGINMCTLIAMDLGEMCDDTVTYKCPLIAEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAILPEEQDQNYVCKHTYVDRGWGNGCGLFGKGSLVTCAKFQCLEPIEGKVVQHENLKYTVIITVHTGDQHQVGNDTQGVTVEITPQASTVEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCLNTFVLKKEVSETQHGTILIKVEYKGEDAPCKIPFSTEDGQGKAHNGRLITANPVVTKKEEPVNIEAEPPFGESNIVIGIGDKALKINWYKKGSSIGKMFEATARGARRMAILGDTAWDFGSVGGVLNSLGKMVHQIFGSAYTALFSGVSWIMKIGIGVLLTWIGLNSKNTSMSFSCIVIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSASRAWNVWEVEDYGFGVFTTNIWLKLREVYTQSCDHRLMSAAIKDERAVHADMGYWIESQKNGSWKLEKASFIEVKTCTWPKSHTLWSNGVLESDMIIPKSLAGPISQHNHRPGYHTQTAGPWHLGKLELDFNYCEGTTVVITENCGTRGPSLRTTTVSGKLIHEWCCRSCTLPPLRYMGEDGCWYGMEIRPINEKEENMAKSLVSAGSGKMDNFTMGILCLAILFEEVMRGKFGKKHMIAGVLFTFVLLLSGQITWRDMAHTLIMIGSNASDRMGMGVTYLALIATFKIQPFLALGFFLRKLTSRENLLLGVGLAMATTLQLPEDIEQMANGIALGLMTLKLITQFETYQLWTALVSLTCSNTIFTLTVAWRTATLILAGVSLLPLCQSSSMRKTDWLPMTVAAMGVPPLPLFIFSLKDTPKRRSWPLNEGVMAVGLVSILASSLLRNDVPMAGPLVAGGLLIACYVITGTSADLTVEKAADVTWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTHNGKRLEPNWASVKKDLISYGGGWRLSAQWQKGEEVQVIAVEPGKNPKNFQTMPGIFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTAIKSEHTGREIVDLMCHATFTMRLLSPVRVPNYNLIIMDEAHFTDPASIAARGYISTRVGMGEAAAIFMTATPPGTAEAFPQSNAPIQDEERDIPERSWNSGNEWITDFVGKTVWFVPSIKAGNDIANCLRKNGKKVIQLSRKTFDTEYQKTRLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGERNNQILEENMDVEIWTKEGERKKLRPRWLDARTYSDPLALKEFKDFAAGRKSIALDLVTEIGRVPSHLAHRTRNALDNLVMLHTSEHGGRAYRHAVEELPETMETLLLLGLMILLTGGAMLFLISGKGIGKTSIGLICVIVSSGMLWMADVPLQWIASAIVLEFFMMVLLIPEPEKQRTPQDNQLAYVVIGILTLAAIVTANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLVTHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGETTHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVSSVNMVSRLLLNRFTMTHRRPTIEKDVDLGAGTRHVNAEPETPNMDVIGERIKRIKEEHSSTWHYDDENPYKTWAYHGSYEVKATGSASSMINGVVKLLTKPWDVVPMVTQMAMTDTTPFGQQRVFKEKVDTRTPRPMPGTRKVMEITAEWLWRTLGRNKRPRLCTREEFTKKVRTNAAMGAVFTEENQWDSARAAVEDEEFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPKGTVMDIISRKDQRGSGQVGTYGLNTFTNMEAQLVRQMEGEGVLSKVDLENPHLLEKKITQWLETKGVERLRRMAISGDDCVVKPIDDRFANALLALNDMGKVRKDIPQWQPSKGWHDWQQVPFCSHHFHELIMKDGRKLVVPCRPQDELIGRARISQGAGWSLKETACLGKAYAQMWSLMYFHRRDLRLASNAICSAVPVHWVPTSRTTWSIHAHHQWMTTEDMLTVWNRVWIEDNPWMEDKTPVTTWEDVPYLGKREDQWCGSLIGLTSRATWAQNILTAIQQVRSLIGDEEFLDYMPSMKRFRKEEESEGAIW

SEQ ID NO: 4852 - protein, 3290 aa, Artificial Sequence
  derived and/or modified protein sequence (wt) from DENV-3__FJ744734__SS-prME
TSLCLMMMLPATLAFHLTSRDGEPRMIVAKNERGKSLLFKTASGINMCTLIAMDLGEMCDDTVTYKCPLIAEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAILPEEQDQNYVCKHTYVDRGWGNGCGLFGKGSLVTCAKFQCLEPIEGKVVQHENLKYTVIITVHTGDQHQVGNDTQGVTVEITPQASTVEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCLNTFVLKKEVSETQHGTILIKVEYKGEDAPCKIPFSTEDGQGKAHNGRLITANPVVTKKEEPVNIEAEPPFGESNIVIGIGDKALKINWYKKGSSIGKMFEATARGARRMAILGDTAWDFGSVGGVLNSLGKMVHQIFGSAYTALFSGVSWIMKIGIGVLLTWIGLNSKNTSMSFSCIVIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSASRAWNVWEVEDYGFGVFTTNIWLKLREVYTQSCDHRLMSAAIKDERAVHADMGYWIESQKNGSWKLEKASFIEVKTCTWPKSHTLWSNGVLESDMIIPKSLAGPISQHNHRPGYHTQTAGPWHLGKLELDFNYCEGTTVVITENCGTRGPSLRTTTVSGKLIHEWCCRSCTLPPLRYMGEDGCWYGMEIRPINEKEENMVKSLVSAGSGKMDNFTMGILCLAILFEEVMRGKFGKKHMIAGVLFTFVLLLSGQITWRDMAHTLIMIGSNASDRMGMGVTYLALIATFKIQPFLALGFFLRKLTSRENLLLGVGLAMATTLQLPEDIEQMANGIALGLMTLKLITQFETYQLWTALVSLTCSNTIFTLTVAWRTATLILAGVSLLPLCQSSSMRKTDWLPMTVAAMGVPPLPLFIFSLKDTPKRRSWPLNEGVMAVGLVSILASSLLRNDVPMAGPLVAGGLLIACYVITGTSADLTVEKAADVTWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTHNGKRLEPNWASVKKDLISYGGGWRLSAQWQKGEEVQVIAVEPGKNPKNFQTMPGIFQTTMGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTAIKSEHTGREIVDLMCHATFTMRLLSPVRVPNYNLIIMDEAHFTDPASIAARGYISTRVGMGEAAAIFMTATPPGTAEAFPQSNAPIQDEERDIPERSWNSGNEWITDFVGKTVWFVPSIKAGNDIANCLRKNGKKVIQLSRKTFDTEYQKTRLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGERNNQILEENMDVEIWTKEGERKKLRPRWLDARTYSDPLALKEFKDFAAGRKSIALDLVTEIGRVPSHLAHRTRNALDNLVMLHTSEHGGRAYRHAVEELPETMETLLLLGLMILLTGGAMLFLISGKGIGKTSIGLICVIVSSGMLWMADVPLQWIASAIVLEFFMMVLLIPEPEKQRTPQDNQLAYVVIGILTLAAIVTANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLVTHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGETTHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVSSVNMVSRLLLNRFTMTHRRPTIEKDVDLGAGTRHVNAEPETPNMDVIGERIKRIKEEHSSTWHYDDENPYKTWAYHGSYEVKATGSASSMINGVVKLLTKPWDVVPMVTQMAMTDTTPFGQQRVFKEKVDTRTPRPMPGTRKVMEITAEWLWRTLGRNKRPRLCTREEFTKKVRTNAAMGAVFTEENQWDSARAAVEDEEFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPKGTVMDIISRKDQRGSGQVGTYGLNTFTNMEAQLVRQMEGEGVLSKVDLENPHLLEKKITQWLETKGVERLRRMAISGDDCVVKPIDDRFANALLALNDMGKVRKDIPQWQPSKGWHDWQQVPFCSHHFHELIMKDGRKLVVPCRPQDELIGRARISQGAGWSLKETACLGKAYAQMWSLMYFHRRDLRLASNAICSAVPVHWVPTSRTTWSIHAHHQWMTTEDMLTVWNRVWIEDNPWMEDKTPVTTWEDVPYLGKREDQWCGSLIGLTSRATWAQNILTAIQQVRSLIGDEEFLDYMPSMKRFRKEEESEGAIW

SEQ ID NO: 4853 - protein, 3290 aa, Artificial Sequence
  derived and/or modified protein sequence (wt) from DENV-3__FJ744737__SS-prME
TSLCLMMMLPATLAFHLTSRDGEPRMIVAKNERGKSLLFKTASGINMCTLIAMDLGEMCDDTVTYKCPLIAEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAILPEEQDQNYVCKHTYVDRGWGNGCGLFGKGSLVTCAKFQCLEPIEGKVVQHENLKYTVIITVHTGDQHQVGNDTQGVTAEITPQASTVEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCLNTFVLKKEVSETQHGTILIKVEYKGEDAPCKIPFSTEDGQGKAHNGRLITANPVVTKKEEPVNIEAEPPFGESNIVIGIGDKALKINWYKKGSSIGKMFEATARGARRMAILGDTAWDFGSVGGVLNSLGKMVHQIFGSAYTALFSGVSWIMKIGIGVLLTWIGLNSKNTSMSFSCIVIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSASRAWNVWEVEDYGFGVFTTNIWLKLREVYTQSCDHRLMSAAIKDERAVHADMGYWIESQKNGSWKLEKASFIEVKTCTWPKSHTLWSNGVLESDMIIPKSLAGPISQHNHRPGYHTQTAGPWHLGKLELDFNYCEGTTVVITENCGTRGPSLRTTTVSGKLIHEWCCRSCTLPPLRYMGEDGCWYGMEIRPINEKEENMVKSLVSAGSGKMDNFTMGILCLAILFEEVMRGKFGKKHMIAGVLFTFVLLLSGQITWRDMAHTLIMIGSNASDRMGMGVTYLALIATFKIQPFLALGFFLRKLTSRENLLLGVGLAMATTLQLPEDIEQMANGIALGLMTLKLITQFETYQLWTALVSLTCSNTIFTLTVAWRTATLILAGVSLLPLCQSSSMRKTDWLPMTVAAMGVPPLPLFIFSLKDTPKRRSWPLNEGVMAVGLVSILASSLLRNDVPMAGPLVAGGLLIACYVITGTSADLTVEKAADVTWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTHNGKRLEPNWASVKKDLISYGGGWRLSAQWQKGEEVQVIAVEPGKNPKNFQTMPGIFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTAIKSEHTGREIVDLMCHATFTMRLLSPVRVPNYNLIIMDEAHFTDPASIAARGYISTRVGMGEAAAIFMTATPPGTAEAFPQSNAPIQDEERDIPERSWNSGNEWITDFVGKTVWFVPSIKAGNDIANCLRKNGKKVIQLSRKTFDTEYQKTRLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGERNNQILEENMDVEIWTKEGERKKLRPRWLDARTYSDPLALKEFKDFAAGRKSIALDLVTEIGRVPSHLAHRTRNALDNLVMLHTSEHGGRAYRHAVEELPETMETLLLLGLMILLTGGAMLFLISGKGIGKTSIGLICVIVSSGMLWMADVPLQWIASAIVLEFFMMVLLIPEPEKQRTPQDNQLAYVVIGILTLAAIVTANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLVTHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGETTHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVSSVNMVSRLLLNRFTMTHRRPTIEKDVDLGAGTRHVNAEPETPNMDVIGERIKRIKEEHSSTWHYDDENPYKTWAYHGSYEVKATGSASSMINGVVKLLTKPWDVVPMVTQMAMTDTTPFGQQRVFKEKVDTRTPRPMPGTRKVMEITAEWLWRTLGRNKRPRLCTREEFTKKVRTNAAMGAVFTEENQWDSARAAVEDEEFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPKGTVMDIISRKDQRGSGQVGTYGLNTFTNMEAQLVRQMEGEGVLSKVDLENPHLLEKKITQWLETKGVERLRRMAISGDDCVVKPIDDRFANALLALNDMGKVRKDIPQWQPSKGWHDWQQVPFCSHHFHELIMKDGRKLVVPCRPQDELIGRARISQGAGWSLKETACLGKAYAQMWSLMYFHRRDLRLASNAICSAVPVHWVPTSRTTWSIHAHHQWMTTEDMLTVWNRVWIEDNPWMEDKTPVTTWEDVPYLGKREDQWCGSLIGLTSRATWAQNILTAIQQVRSLIGDEEFLDYMPSMKRFRKEEESEGAIW

SEQ ID NO: 4854 - protein, 3290 aa, Artificial Sequence
  derived and/or modified protein sequence (wt) from DENV-3__FJ744739__SS-prME
TSLCLMMMLPATLAFHLTSRDGEPRMIVAKNERGKSLLFKTVSGINMCTLIAMDLGEMCDDTVTYKCPLIAEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAILPEEQDQNYVCKHTYVDRGWGNGCGLFGKGSLVTCAKFQCLEPIEGKVVQHENLKYTVIITVHTGDQHQVGNDTQGVTVEITPQASTVEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCLNTFVLKKEVSETQHGTILIKVEYKGEDAPCKIPFSTEDGQGKAHNGRLITANPVVTKKEEPVNIEAEPPFGESNIVIGIGDKALKINWYKKGSSIGKMFEATARGARRMAILGDTAWDFGSVGGVLNSLGKMVHQIFGSAYTALFSGVSWIMKIGIGVLLTWIGLNSKNTSMSFSCIVIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSASRAWNVWEVEDYGFGVFTTNIWLKLREVYTQSCDHRLMSAAIKDERAVHADMGYWIESQKNGSWKLEKASFIEVKTCTWPKSHTLWSNGVLESDMIIPKSLAGPISQHNHRPGYHTQTAGPWHLGKLELDFNYCEGTTVVITENCGTRGPSLRTTTVSGKLIHEWCCRSCTLPPLRYMGEDGCWYGMEIRPINEKEENMVKSLVSAGSGKMDNFTMGILCLAILFEEVMRGKFGKKHMIAGVLFTFVLLLSGQITWRDMAHTLIMIGSNASDRMGMGVTYLALIATFKIQPFLALGFFLRKLTSRENLLLGVGLAMATTLQLPEDIEQMANGIALGLMTLKLITQFETYQLWTALVSLTCSNTIFTLTVAWRTATLILAGVSLLPLCQSSSMRKTDWLPMTVAAMGVPPLPLFIFSLKDTPKRRSWPLNEGVMAVGLVSILASSLLRNDVPMAGPLVAGGLLIACYVITGTSADLTVEKAADVTWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTHNGKRLEPNWASVKKDLISYGGGWRLSAQWQKGEEVQVIAVEPGKNPKNFQTMPGIFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTAIKSEHTGREIVDLMCHATFTMRLLSPVRVPNYNLIIMDEAHFTDPASIAARGYISTRVGMGEAAAIFMTATPPGTAEAFPQSNAPIQDEERDIPERSWNSGNEWITDFVGKTVWFVPSIKAGNDIANCLRKNGKKVIQLSRKTFDTEYQKTRLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGERNNQILEENMDVEIWTKEGERKKLRPRWLDARTYSDPLALKEFKDFAAGRKSIALDLVTEIGRVPSHLAHRTRNALDNLVMLHTSEHGGRAYRHAVEELPETMETLLLLGLMILLTGGAMLFLISGKGIGKTSIGLICVIVSSGMLWMADVPLQWIASAIVLEFFMMVLLIPEPEKQRTPQDNQLAYVVIGILTLAAIVTANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLVTHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGETTHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVSSVNMVSRLLLNRFTMTHRRPTIEKDVDLGAGTRHVNAEPETPNMDVIGERIKRIKEEHSSTWHYDDENPYKTWAYHGSYEVKATGSASSMINGVVKLLTKPWDVVPMVTQMAMTDTTPFGQQRVFKEKVDTRTPRPMPGTRKVMEITAEWLWRTLGRNKRPRLCTREEFTKKVRTNAAMGAVFTEENQWDSARAAVEDEEFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPKGTVMDIISRKDQRGSGQVGTYGLNTFTNMEAQLVRQMEGEGVLSKVDLENPHLLEKKITQWLETKGVERLRRMAISGDDCVVKPIDDRFANALLALNDMGKVRKDIPQWQPSKGWHDWQQVPFCSHHFHELIMKDGRKLVVPCRPQDELIGRARISQGAGWSLKETACLGKAYAQMWSLMYFHRRDLRLASNAICSAVPVHWVPTSRTTWSIHAHHQWMTTEDMLTVWNRVWIEDNPWMEDKTPVTTWEDVPYLGKREDQWCGSFIGLTSRATWAQNILTAIQQVRSLIGDEEFLDYMPSMKRFRKEEESEGAIW

SEQ ID NO: 4855 - protein, 3290 aa, Artificial Sequence
  derived and/or modified protein sequence (wt) from DENV-3__FJ744740__SS-prME
TSLCLMMMLPATLAFHLTSRDGEPRMIVAKNERGKSLLFKTASGINMCTLIAMDLGEMCDDTVTYKCPLIAEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTIAKNKPTLDIELQKTEATQLATLRKLCIEGKITNITTDSRCPTQGEAILPEEQDQNYVCKHTYVDRGWGNGCGLFGKGSLVTCAKFQCLEPIEGKVVQHENLKYTVIITVHTGDQHQVGNDTQGVTVEITPQASTVEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCLNTFVLKKEVSETQHGTILIKVEYKGEDAPCKIPFSTEDGQGKAHNGRLITANPVVTKKEEPVNIEAEPPFGESNIVIGVGDKALKINWYKKGSSIGKMFEATARGARRMAILGDTAWDFGSVGGVLNSLGKMVHQIFGSAYTALFSGVSWIMKIGIGVLLTWIGLNSKNTSMSFSCIVIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSASRAWNVWEVEDYGFGVFTTNIWLKLREVYTQSCDHRLMSAAIKDERAVHADMGYWIESQKNGSWKLEKASFIEVKTCTWPKSHTLWSNGVLESDMIIPKSLAGPISQHNHRPGYHTQTAGPWHLGKLELDFNYCEGTTVVITENCGTRGPSLRTTTVSGKLIHEWCCRSCTLPPLRYMGEDGCWYGMEIRPINEKEENMVKSLVSAGSGKVDNFTMGILCLAILFEEVMRGKFGKKHMIAGVLFTFVLLLSGQITWRDMAHTLIMIGSNASDRMGMGVTYLALIATFKIQPFLALGFFLRKLTSRENLLLGVGLAMATTLQLPEDIEQMANGIALGLMTLKLITQFETYQLWTALVSLTCSNTIFTLTVAWRTATLILAGVSLLPLCQSSSMRKTDWLPMTVAAMGVPPLPLFIFSLKDTPKRRSWPLNEGVMAVGLVSILASSLLRNDVPMAGPLVAGGLLIACYVITGTSADLTVEKAADVTWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTHNGKRLEPNWASVKKDLISYGGGWRLSAQWQKGEEVQVIAVEPGKNPKNFQTMPGIFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTAIKSEHTGREIVDLMCHATFTMRLLSPVRVPNYNLIIMDEAHFTDPASIAARGYISTRVGMGEAAAIFMTATPPGTAEAFPQSNAPIQDEERDIPERSWNSGNEWITDFVGKTVWFVPSIKAGNDIANCLRKNGKKVIQLSRKTFDTEYQKTRLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGERNNQILEENMDVEIWTKEGERKKLRPRWLDARTYSDPLALKEFKDFAAGRKSIALDLVTEIGRVPSHLAHRTRNALDNLVMLHTSEHGGRAYRHAVEELPETMETLLLLGLMILLTGGAMLFLISGKGIGKTSIGLICVIVSSGMLWMADVPLQWIASAIVLEFFMMVLLIPEPEKQRTPQDNQLAYVVIGILTLAAIVTANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLVTHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGETTHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVSSVNMVSRLLLNRFTMTHRRPTIEKDVDLGAGTRHVNAEPETPNMDVIGERIKRIKEEHSSTWHYDDENPYKTWAYHGSYEVKATGSASSMINGVVKLLTKPWDVVPMVTQMAMTDTTPFGQQRVFKEKVDTRTPRPMPGTRKVMEITAEWLWRTLGRNKRPRLCTREEFTKKVRTNAAMGAVFTEENQWDSARAAVEDEEFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPKGTVMDIISRKDQRGSGQVGTYGLNTFTNMEAQLVRQMEGEGVLSKVDLENPHLLEKKITQWLETKGVERLRRMAISGDDCVVKPIDDRFANALLALNDMGKVRKDIPQWQPSKGWHDWQQVPFCSHHFHELIMKDGRKLVVPCRPQDELIGRARISQGAGWSLKETACLGKAYAQMWSLMYFHRRDLRLASNAICSAVPVHWVPTSRTTWSIHAHHQWMTTEDMLTVWNRVWIEDNPWMEDKTPVTTWEDVPYLGKREDQWCGSLIGLTSRATWAQNILTAIQQVRSLIGDEEFLDYMPSMKRFRKEEESEGAIW

SEQ ID NO: 4856 - protein, 3290 aa, Artificial Sequence
  derived and/or modified protein sequence (wt) from DENV-3__GQ868593__SS-prME
TSLCLMMMLPATLAFHLTSRDGEPRMIVGKNERGKSLLFKTASGINMCTLIAMDLGEMCDDTVTYKCPHIAEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLILVTPSMAMRCVGVGNRDFVEGLSGATWVDVVLEHGGCVTTMAKNKPTLDIELQKTEATQLATLRKLCIEGKITNITTDSRCPTQGEAILPEEQDQNYVCKHTYVDRGWGNGCGLFGKGSLVTCAKFQCLESIEGKVVQHENLKYTVIITVHTGDQHQVGNETQGVTAEITPQASTVEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCLNTFVLKKEVSETQHGTILIKVEYKGEDAPCKIPFSTEDGQGKAHNGRLITANPVVTKKEEPVNIEAEPPFGESNIVIGIGDKALKINWYKKGSSIGKMFEATARGARRMAILGDTAWDFGSVGGVLNSLGKMVHQIFGSAYTALFSGVSWIMKIGIGVLLTWIGLNSKNTSMSFSCIAIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSASRAWNVWEVEDYGFGVFTTNIWLKLREVYTQLCDHRLMSAAVKDERAVHADMGYWIESQKNGSWKLEKASLIEVKTCTWPKSHTLWSNGVLESDMIIPKSLAGPISQHNHRPGYHTQTAGPWHLGKLELDFNYCEGTTVVITENCGTRGPSLRTTTVSGKLIHEWCCRSCTLPPLRYMGEDGCWYGMEIRPINEKEENMVKSLASAGSGKVDNFTMGVLCLAILFEEVMRGKFGKKHMIAGVLLTFVLLLSGQITWRDMAHTLIMIGSNASDRMGMGVTYLALIATFKIQPFLALGFFLRKLTSRENLLLGVGLAMATTLQLPEDIEQMANGIALGLMALKLITQFETYQLWTALVSLTCSNTIFTLTVAWRTATLILAGVSLLPVCQSSSMRKTDWLPMAVAAMGVPPLPLFIFSLKDTLKRRSWPLNEGVMAVGLVSILASSLLRNDVPMAGPLVAGGLLIACYVITGTSADLTVEKAADVTWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTHNGKRLEPNWASVKKDLISYGGGWRLSAQWQKGEEVQVIAVEPGKNPKNFQTMPGIFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFVGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGERNNQILEENMDVEIWTKEGEKKKLRPRWLDARTYSDPLALKEFKDFAAGRKSIALDLVTEIGRVPSHLAHRTRNALDNLVMLHTSEHGGRAYRHAVEELPETMETLLLLGLMILLTGGAMLFLISGKGIGKTSIGLICVIASSGMLWMADVPLQWIASAIVLEFFMMVLLIPEPEKQRTPQDNQLAYVVIGILTLAAIVAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLATHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGEITRHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVSSVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVIQMAMTDTTPFGQQRVFKEKVDTRTPRPMPGTRKVMEITAEWLWRTLGRNKRPRLCTREEFTKKVRTNAAMGAVFTEENQWDSARAAVEDEEFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPKGTVMDIISRKDQRGSGQVGTYGLNTFTNMEAQLVRQMEGEGVLSKADLENPHLLEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLKETACLGKAYAQMWSLMYFHRRDLRLASNAICSAVPVHWVPTSRTTWSIHAHHQWMTTEDMLTVWNRVWIEDNPWMEDKTPVTTWEDVPYLGKREDQWCGSLIGLTSRATWAQNILTAIQQVRSLIGNEEFLDYMPSMKRFKKEEESEGAIW

SEQ ID NO: 4857 - protein, 3290 aa, Artificial Sequence
  derived and/or modified protein sequence (wt) from DENV-3__FJ898459__SS-prME
TSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAVLPEEQDQNYVCKHTYVDRGWGNGCGLFGKGSLVTCAKFQCLEPIEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDAPCKIPFSTEDGQGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSASRAWNVWEVEDYGFGVFTTNIWLKLREVYTQLCDHRLMSAAVKDERAVHADMGYWIESQKNGSWKLEKASLIEVKTCTWPKSHTLWSNGVLESDMIIPKSLAGPISQHNHRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGKVDNFTMGVLCLAILFEEVMRGKFGKKHMIAGVFFTFVLLLSGQITWRDMAHTLIMIGSNASDRMGMGVTYLALIATFKVQPFLALGFFLRKLTSRENLLLGVGLAMATTLQLPEDIEQMANGIALGLMALKLITQFETYQLWTALISLTCSNTMFTLTVAWRTATLILAGVSLLPVCQSSSMRKTDWLPMAVAAMGVPPLPLFIFSLKDTLKRRSWPLNEGVMAVGLVSILASSLLRNDVPMAGPLVAGGLLIACYVITGTSADLTVEKAADITWEEEAEQTGVSHNLMITVDDDGTMRIKDDETENILTVLLKTALLIVSGVFPYSIPATLLVWHTWQKQTQRSGVLWDVPSPPETQKAELEEGVYRIKQQGIFGKTQVGVGVQKEGVFHTMWHVTRGAVLTYNGKRLEPNWASVKKDLISYGGGWRLSAQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKDFAAGRKSIALDLVTEIGRVPSHLAHRTRNALDNLVMLHTSEHGGRAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGETTHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVASVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRSMPGTRRVMGITAEWLWRTLGRNKKPRLCTREEFTKKVRTNAAMGAVFTEENQWDSAKAAVEDEDFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPTGTVMDIISRKDQRGSGQVGTYGLNTFTNMEAQLIRQMEGEGVLSKADLENPHLPEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLRETACLGKAYAQMWSLMYFHRRDLRLASNAICSAVPVHWVPTSRTTWSIHAHHQWMTTEDMLTVWNRVWIEDNPWMEDKTPVTTWENVPYLGKREDQWCGSLIGLTSRATWAQNIPTAIQQVRSLIGNEEFLDYMPSMKRFRKEEESEGAIW

SEQ ID NO: 4858 - protein, 3290 aa, Artificial Sequence
  derived and/or modified protein sequence (wt) from DENV-3__EU482555__SS-prME
TSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAVLPEEQDQNYVCKHTYVDRGWGNGCGLFGKGSLVTCAKFQCLEPIEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDAPCKIPFSTEDGQGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGVITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAEIQNSSFIIDGPNTPECPSASRAWNVWEVEDYGFGVFTTNIWLKLREVYTQLCDHRLMSAAVKDERAVHADMGYWIESQKNGSWKLEKASLIEVKTCTWPKSHTLWSNGVLESDMIIPKSLAGPISQHNYRPGYHTQTAGPWHLGKLDLDFNYCEGTTVVITENCGTRGPSLRTTTVSGKLIHEWCCRSCTLPPLRYMGEDGCWYGMEIRPISEKEENMVKSLVSAGSGKVDNFTMGVLCLAILFEEVMRGKFGKKHMIAGVFFTFVLLLSGQITWRDMAHTLIMIGSNASDKMGMGVTYLALIATFKIQPFLALGFFLRKLTSRENLLLGVGLAMATTLQLPEDIEQMANGIALGLMALKLITQFETYQLWTALISLTCSNTMFTLTVAWRTATLILAGVSLLPVCQSSSMRKTDWLPMAVAAMGVPPLPLFIFSLKDTLKRRSWPLNEGVMAVGLVSILASSLLRNDVPMAGPLVAGGLLIACYVITGTSADLTVEKAADITWEEEAEQTGVSHNLMITVDDDGTMRIKDDETENILTVLLKTALLIVSGVFPYSIPATLLVWHTWQKQTQRSGVLWDVPSPPETQKAELEEGVYRIKQQGIFGKTQVGVGVQKEGVFHTMWHVTRGAVLTYNGKRLEPNWASVKKDLISYGGGWRLSAQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKDFAAGRKSIALDLVTEIGRVPSHLAHRTRNALDNLVMLHTSEHGGRAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGETTHHAVSRGTAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVASVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRSMPGTRRVMGITAEWLWRTLGRNKKPRLCTREEFTKKVRTNAAMGAVFTEENQWDSAKAAVEDEDFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPTGTVMDIISRKDQRGSGQVGTYGLNTFTNMEAQLIRQMEGEGVLSKADLENPHLPEKKITQWLETKGVERLRRMAISGDDCVVKPIDDRFANALLALNDMGKVRKDIPQWQPSKGWHDWQQVPFCSHHFHELIMKDGRKLVVPCRPQDELIGRARISQGAGWSLRETACLGKAYAQMWSLMYFHRRDLRLASNAICSAVPVHWVPTSRTTWSIHAHHQWMTTEDMLTVWNRVWIEDNPWMEDKTPVTTWENVPYLGKREDQWCGSLIGLTSRATWAQNIPTAIQQVRSLIGNEEFLDYMPSMKRFRKEEESEGAIW

SEQ ID NO: 4859 - protein, 3290 aa, Artificial Sequence
  derived and/or modified protein sequence (wt) from DENV-3__EU529692__SS-prME
TSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAVLPEEQDQNYVCKHTYVDRGWGNGCGLFGKGSLVTCAKFQCLEPIEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDAPCKIPFSTEDGQGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGVITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAEIQNSSFIIDGPNTPECPSASRAWNVWEVEDYGFGVFTTNIWLKLREVYTQLCDHRLMSAAVKDERAVHADMGYWIESQKNGSWKLEKASLIEVKTCTWPKSHTLWSNGVLESDMIIPKSLAGPISQHNYRPGYHTQTAGPWHLGKLDLDFNYCEGTTVVITENCGTRGPSLRTTTVSGKLIHEWCCRSCTLPPLRYMGEDGCWYGMEIRPISEKEENMVKSLVSAGSGKVDNFTMGVLCLAILFEEVMRGKFGKKHMIAGVFFTFVLLLSGQITWRDMAHTLIMIGSNASDKMGMGVTYLALIATFKIQPFLALGFFLRKLTSRENLLLGVGLAMATTLQLPEDIEQMANGIALGLMALKLITQFETYQLWTALISLTCSNTMFTLTVAWRTATLILAGVSLLPVCQSSSMRKTDWLPMAVAAMGVPPLPLFIFSLKDTLKRRSWPLNEGVMAVGLVSILASSLLRNDVPMAGPLVAGGLLIACYVITGTSADLTVEKAADITWEEEAEQTGVSHNLMITVDDDGTMRIKDDETENILTVLLKTALLIVSGVFPYSIPATLLVWHTWQKQTQRSGVLWDVPSPPETQKAELEEGVYRIKQQGIFGKTQVGVGVQKEGVFHTMWHVTRGAVLTYNGKRLEPNWASVKKDLISYGGGWRLSAQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAVVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKDFAAGRKSIALDLVTEIGRVPSHLAHRTRNALDNLVMLHTSEHGGRAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGETTHHAVSRGTAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVASVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRSMPGTRRVMGITAEWLWRTLGRNKKPRLCTREEFTKKVRTNAAMGAVFTEENQWDSAKAAVEDEDFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPTGTVMDIISRKDQRGSGQVGTYGLNTFTNMEVQLIRQMEGEGVLSKADLENPHLPEKKITQWLETKGVERLRRMAISGDDCVVKPIDDRFANALLALNDMGKVRKDIPQWQPSKGWHDWQQVPFCSHHFHELIMKDGRKLVVPCRPQDELIGRARISQGAGWSLRETACLGKAYAQMWSLMYFHRRDLRLASNAICSAVPVHWVPTSRTTWSIHAHHQWMTTEDMLTVWNRVWIEDNPWMEDKTPVTTWENVPYLGKREDQWCGSLIGLTSRATWAQNIPTAIQQVRSLIGNEEFLDYMPSMKRFRKEEESEGAIW

SEQ ID NO: 4860 - protein, 3290 aa, Artificial Sequence
  derived and/or modified protein sequence (wt) from DENV-3__EU482558__SS-prME
TSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAVLPEEQDQNYVCKHTYVDRGWGNGCGLFGKGSLVTCAKFQCLEPIEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDVPCKIPFSTEDGQGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSASRAWNVWEVEDYGFGVFTTNIWLKLREVYTQLCDHRLMSAAVKDERAVHADMGYWIESQKNGSWKLEKASLIEVKTCTWPKSHTLWSNGVLESDMIIPKSLAGPISQHNYRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGKVDNFTMGVLCLAILFEEVMRGKFGKKHMIAGVFFTFVLLLSGQITWRDMAHTLIMIGSNTSDRMGMGVTYLALIATFKIQPFLALGFFLRKLTSRENLLLGVGLAMATTLQLPEDIEQMANGIALGLMALKLITQFETYQLWTALISLTCSNTIFTLTVAWRTATLILAGVSLLPVCQSSSMRKTDWLPMTVAAMGVPPLPLFIFSLKDTLKRRSWPLNEGVMAVGLVSILASSLLRNDVPMAGPLVAGGLLIACYVITGTSADLTVEKAADVTWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTYNGKRLEPNWASVKKDLISYGGGWRLSAQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKDFAAGRKSIALDLVTEIGRVPSHLAHRTRNALDNLVMLHTSEHGGKAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVASVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRSMPGTRRVMGITAEWLWRTLGRNKKPRLCTREEFTKKVRTNAAMGAVFTEENQWDSAKAAVEDEDFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPTGTVMDIISRKDQRGSGQVGTYGLNTFTNMEAQLIRQMEGEGVLSKADLENPHLPEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLRETACLGKAYAQMWSLMYFHRRDLRLASNAICSAVPVHWVPTSRTTWSIHAHHQWMTTEDMLTVWNRVWIEDNPWMEDKTPVTTWENVPYLGKREDQWCGSLIGLTSRATWAQNIPTAIQQVRSLIGNEEFLDYMPSMKRFRKEEESEGAIW

SEQ ID NO: 4861 - protein, 3290 aa, Artificial Sequence
  derived and/or modified protein sequence (wt) from DENV-3__EU482563__SS-prME
TSLCLMMILPAALAFHLTSRDGEPRMIVGKNERGKSLLFKTASGINMCTLIAMDLGEMCDDTVTYKCPHIAEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFVLLMLVTPSMTMRCVGVGNRDFVEGLSGATWVDVVLEHGGCVTTMAKNKPTLDIELQKTEATQLATLRKLCIEGKITNITTDSRCPTQGEAVLPEEQDQNYVCKHTYVDRGWGNGCGLFGKGSLVTCAKFQCLEPIEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDAPCKIPFSTEDGQGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQADTGCVINWKGKELKCGSGIFVTNEVHTWTEQYKFQADSPKRLATAIAGAWENGVCGIRSTTRMENLLWKQVANELNYILWENNIKLTVVVGDIIGVLEQGKRTLTPQPMELKYSWKTWGKAKIVTAETQNSSFIIDGPNTPECPSASRAWNVWEVEDYGFGVFTTNIWLKLREVYTQLCDHRLMSAAVKDERAVHADMGYWIESQKNGSWKLEKASLIEVKTCTWPKSHTLWSNGVLESDMIIPKSLAGPISQHNYRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGKVDNFTMGVLCLAILFEEVMRGKFGKKHMIAGVFFTFVLLLSGQITWRDMAHTLIMIGSNASDRMGMGVTYLALIATFKIQPFLALGFFLRKLTSRENLLLGVGLAMATTLQLPEDIEQMANGIALGLMALKLITQFETYQLWTALISLTCSNTIFTLTVAWRTATLILAGVSLLPVCQSSSMRKSDWLPMTVAAMGVPPLPLFIFSLKDTLKRRSWPLNEGVMAVGLVSILASSLLRNDVPMAGPLVAGGLLIACYVITGTSADLTVEKAADVTWEEEAEQTGVSHNLMITVDDDGTMRIKDDETENILTVLLKTALLIVSGIFPYSIPATLLVWHTWQKQTRRSGVLWDVPSPPETQKAELEEGVYRIKQQGIFGKTQVGVGVQKEGVFHTMWHVTRGAVLTYNGKRLEPNWASVKKDLISYGGGWRLSAQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKDFAAGRKSIALDLVTEIGRVPSHLAHRTRNALDNLVMLHTSEHGGKAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVASVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRSMPGTRRVMGITAEWLWRTLGRNKKPRLCTREEFTKKVRTNAAMGAVFTEENQWDSAKAAVEDEDFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPTGTVMDIISRKDQRGSGQVGTYGLNTFTNMEAQLIRQMEGEGVLTKADLENPHLSEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLRETACLGKAYAQMWSLMYFHRRDLRLASNAICSAVPVHWVPTSRTTWSIHAHHQWMTTEDMLTVWNRVWIEDNPWMEDKTPVTTWENVPYLGKREDQWCGSLIGLTSRATWAQNIPTAIQQVRSLIGNEEFLDYMPSMKRFRKEEESEGAIW

SEQ ID NO: 4862 - protein, 3290 aa, Artificial Sequence
  derived and/or modified protein sequence (wt) from DENV-3__EU529696__SS-prME
TSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAVLPEEQDQNYVCKHTYVDRGWGNGCGLFGKGSLVTCAKFQCLEPIEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDAPCKIPFSTEDGQGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGVITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAEIQNSSFIIDGPNTPECPSASRAWNVWEVEDYGFGVFTTNIWLKLREVYTQLCDHRLMSAAVKDERAVHADMGYWIESQKNGSWKLEKASLIEVKTCTWPKSHTLWSNGVLESDMIIPKSLAGPISQHNYRPGYHTQTAGPWHLGKLDLDFNYCEGTTVVITENCGTRGPSLRTTTVSGKLIHEWCCRSCTLPPLRYMGEDGCWYGMEIRPISEKEENMVKSLVSAGSGKVDNFTMGVLCLAILFEEVMRGKFGKKHMIAGVFFTFVLLLSGQITWRDMAHTLIMIGSNASDKMGMGVTYLALIATFKIQPFLALGFFLRKLTSRENLLLGVGLAMATTLQLPEDIEQMANGIALGLMALKLITQFETYQLWTALISLTCSNTMFTLTVAWRTATLILAGVSLLPVCQSSSMRKTDWLPMAVAAMGVPPLPLFIFSLKDTLKRRSWPLNEGVMAVGLVSILASSLLRNDVPMAGPLVAGGLLIACYVITGTSADLTVEKAADITWEEEAEQTGVSHNLMITVDDDGTMRIKDDETENILTVLLKTALLIVSGVFPYSIPATLLVWHTWQKQTQRSGVLWDVPSPPETQKAELEEGVYRIKQQGIFGKTQVGVGVQKEGVFHTMWHVTRGAVLTYNGKRLEPNWASVKKDLISYGGGWRLSAQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAVVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKDFAAGRKSIALDLVTEIGRVPSHLAHRTRNALDNLVMLHTSEHGGRAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGETTHHAVSRGTAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVASVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRSMPGTRRVMGITAEWLWRTLGRNKKPRLCTREEFTKKVRTNAAMGAVFTEENQWDSAKAAVEDEDFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPTGTVMDIISRKDQRGSGQVGTYGLNTFTNMEAQLIRQMEGEGVLSKADLENPHLPEKKITQWLETKGVERLRRMAISGDDCVVKPIDDRFANALLALNDMGKVRKDIPQWQPSKGWHDWQQVPFCSHHFHELIMKDGRKLVVPCRPQDELIGRARISQGAGWSLRETACLGKAYAQMWSLMYFHRRDLRLASNAICSAVPVHWVPTSRTTWSIHAHHQWMTTEDMLTVWNRVWIEDNPWMEDKTPVTTWENVPYLGKREDQWCGSLIGLTSRATWAQNIPTAIQQVRSLIGNEEFLDYMPSMKRFRKEEESEGAIW

SEQ ID NO: 4863 - protein, 3290 aa, Artificial Sequence
  derived and/or modified protein sequence (wt) from DENV-3__EU529697__SS-prME
TSLCLMMILPAALAFHLTSRDGEPRMIVGKNERGKSLLFKTASGINMCTLIAMDLGEMCDDTVTYKCPHIAEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFVLLMLVTPSMTMRCVGVGNRDFVEGLSGATWVDVVLEHGGCVTTMAKNKPTLDIELQKTEATQLATLRKLCIEGKITNITTDSRCPTQGEAALPEEQDQNYVCKHTYVDRGWGNGCGLFGKGSLVTCAKFQCLEPIEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDAPCKIPFSTEDGQGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQADTGCVINWKGKELKCGSGIFVTNEVHTWTEQYKFQADSPKRLATAIAGAWENGVCGIRSTTRMENLLWKQVANELNYILWENNIKLTVVVGDIIGVLEQGKRTLTPQPMELKYSWKTWGKAKIVTAETQNSSFIIDGPNTPECPSASRAWNVWEVEDYGFGVFTTNIWLKLREVYTQLCDHRLMSAAVKDERAVHADMGYWIESQKNGSWKLEKASLIEVKTCTWPKSHTLWSNGVLESDMIIPKSLAGPISQHNYRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGKVDNFTMGVLCLAILFEEVMRGKFGKKHMIAGVFFTFVLLLSGQITWRDMAHTLIMIGSNASDRMGMGVTHLALIATFKIQPFLALGFFLRKLTSRENLLLGVGLAMATTLQLPEDIEQMANGIALGLMALKLITQFETYQLWTALISLTCSNTIFTLTVAWRTATLILAGVSLLPVCQSSSMRKSDWLPMTVAAMGVPPLPLFIFSLKDTLKRRSWPLNEGVMAVGLVSILASSLLRNDVPMAGPLVAGGLLIACYVITGTSADLTVEKAADVTWEEEAEQTGVSHNLMITVDDDGTMRIKDDETENILTVLLKTALLIVSGIFPYSIPATLLVWHTWQKQTRRSGVLWDVPSPPETQKAELEEGVYRIKQQGIFGKTQVGVGVQKEGVFHTMWHVTRGAVLTYNGKRLEPNWASVKKDLISYGGGWRLSAQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKDFAAGRKSIALDLVTEIGRVPSHLAHRTRNALDNLVMLHTSEHGGKAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLNKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVASVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRSMPGTRRVMGITAEWLWRTLGRNKKPRLCTREEFTKKVRTNAAMGAVFTEENQWDSAKAAVEDEDFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPTGTVMDIISRKDQRGSGQVGTYGLNTFTNMEAQLIRQMEGEGVLTKADLENPHLSEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLRETACLGKAYAQMWSLMYFHRRDLRLASNAICSAVPVHWVPTSRTTWSIHAHHQWMTTEDMLTVWNRVWIEDNPWMEDKTPVTTWENVPYLGKREDQWCGSLIGLTSRATWAQNIPTAIQQVRSLIGNEEFLDYMPSMKRFRKEEESEGAIW

SEQ ID NO: 4864 - protein, 3290 aa, Artificial Sequence
  derived and/or modified protein sequence (wt) from DENV-3__EU482564__SS-prME
TSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAVLPEEQDQNYVCKHTYVDRGWGNGCGLFGKGSLVTCAKFQCLEPIEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDAPCKIPFSTEDGQGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGVITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAEIQNSSFIIDGPNTPECPSASRAWNVWEVEDYGFGVFTTNIWLKLREVYTQLCDHRLMSAAVKDERAVHADMGYWIESQKNGSWKLEKASLIEVKTCTWPKSHTLWSNGVLESDMIIPKSLAGPISQHNYRPGYHTQTAGPWHLGKLDLDFNYCEGTTVVITENCGTRRPSLRTTTVSGKLIHEWCCRSCTLPPLRYMGEDGCWYGMEIRPISEKEENMVKSLVSAGSGKVDNFTMGVLCLAILFEEVMRGKFGKKHMIAGVFFTFVLLLSGQITWRDMAHTLIMIGSNASDKMGMGVTYLALIATFKIQPFLALGFFLRKLTSRENLLLGVGLAMATTLQLPEDIEQMANGIALGLMALKLITQFETYQLWTALISLTCSNTMFTLTVAWRTATLILAGVSLLPVCQSSSMRKTDWLPMAVAAMGVPPLPLFIFSLKDTLKRRSWPLNEGVMAVGLVSILASSLLRNDVPMAGPLVAGGLLIACYVITGTSADLTVEKAADITWEEEAEQTGVSHNLMITVDDDGTMRIKDDETENILTVLLKTALLIVSGVFPYSIPATLLVWHTWQKQTQRSGVLWDVPSPPETQKAELEEGVYRIKQQGIFGKTQVGVGVQKEGVFHTMWHVTRGAVLTYNGKRLEPNWASVKKDLISYGGGWRLSAQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAVVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKDFAAGRKSIALDLVTEIGRVPSHLAHRTRNALDNLVMLHTSEHGGRAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGETTHHAVSRGTAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVASVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRSMPGTRRVMGITAEWLWRTLGRNKKPRLCTREEFTKKVRTNAAMGAVFTEENQWDSAKAAVEDEDFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPTGTVMDIISRKDQRGSGQVGTYGLNTFTNMEAQLIRQMEGEGVLSKADLENPHLPEKKITQWLETKGVERLRRMAISGDDCVVKPIDDRFANALLALNDMGKVRKDIPQWQPSKGWHDWQQVPFCSHHFHELIMKDGRKLVVPCRPQDELIGRARISQGAGWSLRETACLGKAYAQMWSLMYFHRRDLRLASNAICSAVPVHWVPTSRTTWSIHAHHQWMTTEDMLTVWNRVWIEDNPWMEDKTPVTTWENVPYLGKREDQWCGSLIGLTSRATWAQNIPTAIQQVRSLIGNEEFLDYMPSMKRFRKEEESEGAIW

SEQ ID NO: 4865 - protein, 3290 aa, Artificial Sequence
  derived and/or modified protein sequence (wt) from DENV-3__EU529699__SS-prME
TSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAVLPEEQDQNYVCKHTYVDRGWGNGCGLFGKGSLVTCAKFQCLEPIEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDVPCKIPFSTEDGQGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDTIGVLEQGKRTLTPQPMELKYSWKTWGKAKIVTAETQNSSFIIDGPNTPECPSASRAWNVWEVEDYGFGVFTTNIWLKLREVYTQLCDHRLMSAAVKDERAVHADMGYWIESQKNGSWKLEKASLIEVKTCTWPKSHTLWSNGVLESDMIIPKSLAGPISQHNYRPGYHTQTAGPWHLGKLELDFNYCEGTTVVITENCGTRGPSLRTTTVSGKLIHEWCCRSCTLPPLRYMGEDGCWYGMEIRPVSEKEENMVKSLVSAGSGKVDNFTMGVLCLAILFEEVMRGKFGKKHMIAGVFFTFVLLLSGQITWRDMAHTLIMIGSNASDRMGMGVTYLALIATFKIQPFLALGFFLRKLTSRENLLLGVGLAMATTLQLPEDIEQMANGIALGLMALKLITQFETYQLWTALISLTCSNTIFTLTVAWRTATLILAGVSLLPVCQSSSMRKTDWLPMTVAAMGVPPLPLFIFSLKDTLKRRSWPLNEGVMAVGLVSILASSLLRNDVPMAGPLVAGGLLIACYVITGTSADLTVEKAADVTWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTYNGKRLEPNWASVKKDLISYGGGWRLSAQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKDFAAGRKSIALDLVTEIGRVPSHLAHRTRNALDNLVMLHTSEHGGKAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVASVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRSMPGTRRVMGITAEWLWRTLGRNKKPRLCTREEFTKKVRTNAAMGAVFTEENQWDSAKAAVEDEDFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPTGTVMDIISRKDQRGSGQVGTYGLNTFTNMEAQLIRQMEGEGVLSKADLENPHLPEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLRETACLGKAYAQMWSLMYFHRRDLRLASNAICSAVPVHWVPTSRTTWSIHAHHQWMTTEDMLTVWNRVWIEDNPWMEDKTPVTTWENVPYLGKREDQWCGSLIGLTSRATWAQNIPTAIQQVRSLIGNEEFLDYMPSMKRFRKEEESEGAIW

SEQ ID NO: 4866 - protein, 3290 aa, Artificial Sequence
  derived and/or modified protein sequence (wt) from DENV-3__EU482566__SS-prME
TSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFTLLMLVTPSMTMRCVGVGNRDFVEGLSGATWVDVVLEHGGCVTTMAKNKPTLDIELQKTEATQLATLRKLCIEGKITNITTDSRCPTQGEAVLPEEQDQNYVCKHTYVDRGWGNGCGLFGKGSLVTCAKFQCLEPIEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDVPCKIPFSTEDGQGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSASRAWNVWEVEDYGFGVFTTNIWLKLREVYTQLCDHRLMSAAVKDERAVHADMGYWIESQKNGSWKLEKASLIEVKTCTWPKSHTLWSNGVLESDMIIPKSLAGPISQHNYRPGYHTQTAGPWHLGKLELDFNYCEGTTVVITENCGTKGPSLRTTTVSGKLIHEWCCRSCTLPPLRYMGEDGCWYGMEIRPISEKEENMVKSLVSAGSGKVDNFTMGVLCLAILFEEVMRGKFGKKHMIAGVFFTFVLLLSGQITWRDMAHTLIMIGSNASDRMGMGVTYLALIATFKIQPFLALGFFLRKLTSRENLLLGVGLAMATTLQLPEDIEQMANGIALGLMALKLITQFETYQLWTALISLTCSNTIFTLTVAWRTATLILAGVSLLPVCQSSSMRKTDWLPMTVAAMGVPPLPLFIFSLKDTLKRRSWPLNEGVMAVGLVSILASSLLRNDVPMAGPLVAGGLLIACYVITGTSADLTVEKAADVTWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTYNGKRLEPNWASVKKDLISYGGGWRLSAQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKDFAAGRKSIALDLVTEIGRVPSHLAHRTRNALDNLVMLHTSEHGGKAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVASVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRSMPGTRRVMGITAEWLWRTLGRNKKPRLCTREEFTKKVRTNAAMGAVFTEENQWDSAKAAVEDEDFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPTGTVMDIISRKDQRGSGQVGTYGLNTFTNMEAQLIRQMEGEGVLSKADLENPHLPEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLRETACLGKAYAQMWSLMYFHRRDLRLASNAICSAVPVHWVPTSRTTWSIHAHHQWMTTEDMLTVWNRVWIEDNPWMEDKTPVTTWENVPYLGKREDQWCGSLIGLTSRATWAQNIPTAIQQVRSLIGNEEFLDYMPSMKRFRKEEESEGAIW

SEQ ID NO: 4867 - protein, 3290 aa, Artificial Sequence
  derived and/or modified protein sequence (wt) from DENV-3__EU529702__SS-prME
TSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYVGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAVLPEEQDQNYVCKHTYVDRGWGNGCGLFGKGSLVTCAKFQCLEPIEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDVPCKVPFSTEDGQGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIVIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSASRAWNVWEVEDYGFGVFSTNIWLKLREVYTQLCDHRLMSAAVKDERAVHADMGYWIESQKNGSWKLEKASLIEVKTCTWPKSHTLWSNGVLESDMIIPKSLAGPISQHNYRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGKVDNFTMGALCLAILFEEVMRGKFGKKHMIAGVFFTFVLLLSGQITWRDMAHTLIMIGSNASDRMGMGVTYLALIATFKIQPFLALGFFLRKLTSRENLLLGVGLAMATTLQLPEDIEQMANGIALGLMALKLITQFETYQLWTALISLTCSNTIFTLTVAWRTATLILAGVSLLPVCQSSSMRKTDWLPMTVAAMGVPPLPLFIFSLKDTLKRRSWPLNEGVMAVGLVSILASSLLRNDVPMAGPLVAGGLLIACYVITGTSADLTVEKAADVTWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTYNGKRLEPNWASVKKDLISYGGGWRLSAQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKDFAAGRKSIALDLVTEIGRVPSHLAHRTRNALDNLVMLHTSEHGGKAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVASVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRSMPGTRRVMGITAEWLWRTLGRNKKPRLCTREEFTKKVRTNAAMGAVFTEENQWDSAKAAVEDEDFWTLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPTGTVMDIISRKDQRGSGQVGTYGLNTFTNMEAQLIRQMEGEGVLSKADLENPHLPEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLRETACLGKAYAQMWSLMYFHRRDLRLASNAICSAVPVHWVPTSRTTWSIHAHHQWMTTEDMLTVWNRVWIEDNPWMEDKTPVTTWENVPYLGKREDQWCGSLIGLTSRATWAQNIPTAIQQVRSLIGNEEFLDYMPSMKRFRKEEESEGAIW

SEQ ID NO: 4868 - protein, 3290 aa, Artificial Sequence
  derived and/or modified protein sequence (wt) from DENV-3__EU529703__SS-prME
TSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAALPEEQDQNYVCKHTYVDRGWGNGCGLFGKGSLVTCAKFQCLEPIEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDAPCKIPFSTEDGQGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSASRAWNVWEVEDYGFGVFTTNIWLKLREVYTQLCDHRLMSAAVKDERAVHADMGYWIESQKNGSWKLEKASLIEVKTCTWPKSHTLWSNGVLESDMIIPKSLAGPISQHNHRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGKVDNFTMGVLCLAILFEEVMRGKFGKKHMIAGVFFTFVLLLSGQITWRDMAHTLIMIGSNASDRMGMGVTYLALIATFKIQPFLALGFFLRKLTSRENLLLGVGLAMATTLQLPEDIEQMANGIALGLMALKLITQFETYQLWTALISLTCSNTIFTLTVAWRTATLILAGVSLLPVCQSSSMRKTDWLPMAVAAMGVPPLPLFIFSLKDTLKRRSWPLNEGVMAVGLVSILASSLLRNDVPMAGPLVAGGLLIACYVITGTSADLTVEKAADITWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTYNGKRLEPNWASVKKDLISYGGGWRLSAQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKDFAAGRKSIALDLVTEIGRVPSHLAHRTRNALDNLVMLHTSEHGGRAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVASVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRSMPGTRRVMGITAEWLWRTLGRNKKPRLCTREEFTKKVRTNAAMGAVFTEENQWDSAKAAVEDEDFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPTGTVMDIISRKDQRGSGQVGTYGLNTFTNMEAQLIRQMEGEGVLSKADLESHHLPEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLRETACLGKAYAQMWSLMYFHRRDLRLASNAICSAVPVHWVPTSRTTWSIHAHHQWMTTEDMLTVWNRVWIEDNPWMEDKTPVTTWENVPYLGKREDQWCGSLIGLTSRATWAQNIPTAIQQVRSLIGNEEFLDYMPSMKRFRKEEESEGAIW

SEQ ID NO: 4869 - protein, 3290 aa, Artificial Sequence
  derived and/or modified protein sequence (wt) from DENV-3__EU529705__SS-prME
TSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGIGNRDFVEGLSGATWVDVVLEHGGCVTTMAKNKPTLDIELQKTEATQLATLRKLCIEGKITNITTDSRCPTQGEAVLPEEQDQNYVCKHTYVDRGWGNGCGLFGKGSLVTCAKFQCLEPIEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLGLKGMSYAMCTNTFVLKKEVSETQHGTILIKVEYKGEDVPCKVPFSTEDGQGKAHSGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGILLTWIGLNSKNTSMSFSCIVIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKAWGKAKIVTAETQNSSFIIDGPNTPECPSASRAWNVWEVEDYGFGVFTTNIWLKLREVYTQLCDHRLMSAAVKDERAVHADMGYWIESQKNGSWKLEKASLIEVKTCTWPKSHTLWSNGVLESDMIIPKSLAGPISQHNYRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGKVDNFTMGVLCLAILFEEVMRGKFGKKHMIAGVFFTFVLLLSGQITWRDMAHTLIMIGSNASDRMGMGVTYLALIATFKIQPFLALGFFLRKLTSRENLLLGVGLAMATTLQLPEDIEQMANGIALGLMALKLITQFETYQLWTALISLTCSNTIFTLTVAWRTATLILAGVSLLPVCQSSSMRKTDWLPMTVAAMGVPPLPLFIFSLKDTLKRRSWPLNEGVMAVGLVSILASSLLRNDVPMAGPLVAGGLLIACYVITGTSADLTVEKAADVTWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTYNGKRLEPNWASVKKDLISYGGGWRLSAQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKDFAAGRKSIALDLVTEIGRVPSHLAHRTRNALDNLVMLHTSEHGGRAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVASVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRSMPGTRRVMGITAEWLWRTLGRNKKPRLCTREEFTKKVRTNAAMGAVFTEENQWDSAKAAVEDEDFWILVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLASAIFKLTYQNKVVKVQRPTPTGTVMDIISRKDQRGSGQVGTYGLNTFTNMEAQLIRQMEGEGVLSKADLENPHLPEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLRETACLGKAYAQMWSLMYFHRRDLRLASNAICSAVPVHWVPTSRTTWSIHAHHQWMTTEDMLTVWNRVWIEDNPWMEDKTPVTTWENVPYLGKREDQWCGSLIGLTSRATWAQNIPTAIQQVRSLIGNEEFLDYMPSMKRFRKEEESEGAIW

SEQ ID NO: 4870 - protein, 3290 aa, Artificial Sequence
  derived and/or modified protein sequence (wt) from DENV-3__EU596492__SS-prME
TSLCLMMILPAALAFHLTSRDGEPRMIVGKNERGKSLLFKTASGINMCTLIAMDLGEMCDDTVTYKCPHIAEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFVLLMLVTPSMTMRCVGVGNRDFVEGLSGATWVDVVLEHGGCVTTMAKNKPTLDIELQKTEATQLATLRKLCIEGKITNITTDSRCPTQGEAALPEEQDQNYVCKHTYVDRGWGNGCGLFGKGSLVTCAKFQCLEPIEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDAPCKIPFSTEDGQGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQADTGCVVNWKGKELKCGSGIFVTNEVHTWTEQYKFQADSPKRLATAIAGAWENGVCGIRSTTRMENLLWKQVANELNYILWENNIKLTVVVGDIIGVLEQGKRTLTPQPMELKYSWKTWGKAKIVTAETQNSSFIIDGPNTPECPSASRAWNVWEVEDYGFGVFTTNIWLKLREVYTQLCDHRLMSAAVKDERAVHADMGYWIESQKNGSWKLEKASLIEVKTCTWPKSHTLWSNGVLESDMIIPKSLAGPISQHNYRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGKVDNFTMGVLCLAILFEEVMRGKFGKKHMIAGVFFTFVLLLSGQITWRDMAHTLIMIGSNASDRMGMGVTYLALIATFKIQPFLALGFFLRKLTSRENLLLGVGLAMATTLQLPEDIEQMANGIALGLMALKLITQFETYQLWTALISLTCSNTIFTLTVAWRTATLILAGVSLLPVCQSSSMRKSDWLPMTVAAMGVPPLPLFIFSLKDTLKRRSWPLNEGVMAVGLVSILASSLLRNDVPMAGPLVAGGLLIACYVITGTSADLTVEKAADVTWEEEAEQTGVSHNLMITVDDDGTMRIKDDETENILTVLLKTALLIVSGIFPYSIPATLLVWHTWQKQTRRSGVLWDVPSPPETQKAELEEGVYRIKQQGIFGKTQVGVGVQKEGVFHTMWHVTRGAVLTYNGKRLEPNWASVKKDLISYGGGWRLSAQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKDFAAGRKSIALDLVTEIGRVPSHLAHRTRNALDNLVMLHTSEHGGKAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLNKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVASVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRSMPGTRRVMGITAEWLWRTLGRNKKPRLCTREEFTKKVRTNAAMGAVFTEENQWDSAKAAVEDEDFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPTGTVMDIISRKDQRGSGQVGTYGLNTFTNMEAQLIRQMEGEGVLTKADLENPHLSEKKITQWLETKGVERLKRMAISGDDCVVKPIDDRFANALLALNDMGKVRKDMPQWQPSKGWHDWQQVPFCSHHFHELIMKDGRKLVVPCRPQDELIGRARISQGAGWSLRETACLGKAYAQMWSLMYFHRRDLRLASNAICSAVPVHWVPTSRTTWSIHAHHQWMTTEDMLTVWNRVWIEDNPWMEDKTPVTTWENVPYLGKREDQWCGSLIGLTSRATWAQNIPTAIQQVRSLIGNEEFLDYMPSMKRFRKEEESEGAIW

SEQ ID NO: 4871 - protein, 3290 aa, Artificial Sequence
  derived and/or modified protein sequence (wt) from DENV-3__EU596493__SS-prME
TSLCLMMILPAALAFHLTSRDGEPRMIVGKNERGKSLLFKTASGINMCTLIAMDLGEMCDDTVTYKCPHIAEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFVLLMLVTPSMTMRCVGVGNRDFVEGLSGATWVDVVLEHGGCVTTMAKNKPTLDIELQKTEATQLATLRKLCIEGKITNITTDSRCPTQGEAVLPEEQDQNYVCKHTYVDRGWGNGCGLFGKGSLVTCAKFQCLEPIEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDAPCKIPFSTEDGQGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQADTGCVINWKGKELKCGSGIFVTNEVHTWTEQYKFQADSPKRLATAIAGAWENGVCGIRSTTRMENLLWKQVANELNYILWENNIKLTVVVGDIIGVLEQGKRTLTPQPMELKYSWKTWGKAKIVTAETQNSSFIIDGPNTPECPSASRAWNVWEVEDYGFGVFTTNIWLKLREVYTQLCDHRLMSAAVKDERAVHADMGYWIESQKNGSWKLEKASLIEVKTCTWPKSHTLWSNGVLESDMIIPKSLAGPISQHNYRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGKVDNFTMGVLCLAILFEEVMRGKFGKKHMIAGVFFTFVLLLSGQITWRDMAHTLIMIGSNASDRMGMGVTYLALIATFKIQPFLALGFFLRKLTSRENLLLGVGLAMATTLQLPEDIEQMANGIALGLMALKLITQFETYQLWTALISLTCSNTIFTLTVAWRTATLILAGVSLLPVCQSSSMRKSDWLPMTVAAMGVPPLPLFIFSLKDTLKRRSWPLNEGVMAVGLVSILASSLLRNDVPMAGPLVAGGLLIACYVITGTSADLTVEKAADVTWEEEAEQTGVSHNLMITVDDDGTMRIKDDETENILTVLLKTALLIVSGIFPYSIPATLLVWHTWQKQTRRSGVLWDVPSPPETQKAELEEGVYRIKQQGIFGKTQVGVGVQKEGVFHTMWHVTRGAVLTYNGKRLEPNWASVKKDLISYGGGWRLNAQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKDFAAGRKSIALDLVTEIGRVPSHLAHRTRNALDNLVMLHTSEHGGKAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKYGGMLVRNPLSRNSTHEMYWISNGTGNIVASVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRSMPGTRRVMGITAEWLWRTLGRNKKPRLCTREEFTKKVRTNAAMGAVFTEENQWDSAKAAVEDEDFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPTGTVMDIISRKDQRGSGQVGTYGLNTFTNMEAQLIRQMEGEGVLTKADLENPHLSEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLRETACLGKAYAQMWSLMYFHRRDLRLASNAICSAVPVHWVPTSRTTWSIHAHHQWMTTEDMLTVWNRVWIEDNPWMEDKTPVTTWENVPYLGKREDQWCGSLIGLTSRATWAQNIPTAIQQVRSLIGNEEFLDYMPSMKRFRKEEESEGAIW

SEQ ID NO: 4872 - protein, 3290 aa, Artificial Sequence
  derived and/or modified protein sequence (wt) from DENV-3__EU596494__SS-prME
TSLCLMMILPAALAFHLTSRDGEPRMIVGKNERGKSLLFKTASGINMCTLIAMDLGEMCDDTVTYKCPHIAEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFVLLMLVTPSMTMRCVGVGNRDFVEGLSGATWVDVVLEHGGCVTTMAKNKPTLDIELQKTEATQLATLRKLCIEGKITNITTDSRCPTQGEAVLPEEQDQNYVCKHTYVDRGWGNGCGLFGKGSLVTCAKFQCLEPIEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGSTEIQNSGGTSIFAGHLKCRLKMDKLELKGMSYAMCTNTFVLKKEVSETQHGTILIKVEYKGEDAPCKIPFSTEDGQGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQADTGCVINWKGKELKCGSGIFVTNEVHTWTEQYKFQADSPKRLATAIAGAWENGVCGIRSTTRMENLLWKQVANELNYILWENNIKLTVVVGDIIGVLEQGKRTLTPQPMELKYSWKTWGKAKIVTAETQNSSFIIDGPNTPECPSASRAWNVWEVEDYGFGVFTTNIWLKLREVYTQLCDHRLMSAAVKDERAVHADMGYWIESQKNGSWKLEKASLIEVKTCTWPKSHTLWSNGVLESDMIIPKSLAGPISQHNYRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGKVDNFTMGVLCLAILFEEVMRGKFGKKHMIAGVFFTFVLLLSGQITWRDMAHTLIMIGSNASDRMGMGVTYLALIATFKIQPFLALGFFLRKLTSRENLLLGVGLAMATTLQLPEDIEQMANGIALGLMALKLITQFETYQLWTALISLTCSNTIFTLTVAWRTATLILAGVSLLPVCQSSSMRKSDWLPMTVAAMGVPPLPLFIFSLKDTLKRRSWPLNEGVMAVGLVSILASSLLRNDVPMAGPLVAGGLLIACYVITGTSADLTVEKAADVTWEEEAEQTGVSHNLMITVDDDGTMRIKDDETENILTVLLKTALLIVSGIFPYSIPATLLVWHTWQKQTRRSGVLWDVPSPPETQKAELEEGVYRIKQQGIFGKTQVGVGVQKEGVFHTMWHVTRGAVLTYNGKRLEPNWASVKKDLISYGGGWRLSAQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATRSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKDFAAGRKSIALDLVTEIGRVPSHLAHRTRNALDNLVMLHTSEHGGKAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVASVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRSMPGTRRVMGITAEWLWRTLGRNKKPRLCTREEFTKKVRTNAAMGAVFTEENQWDSAKAAVEDEDFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPTGTVMDIISRKDQRGSGQVGTYGLNTFTNMEAQLIRQMEGEGVLTKADLENPHLSEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLRETACLGKAYAQMWSLMYFHRRDLRLASNAICSAVPVHWVPTSRTTWSIHAHHQWMTTEDMLTVWNRVWIEDNPWMEDKTPVTTWENVPYLGKREDQWCGSLIGLTSRATWAQNIPTAIQQVRSLIGNEEFLDYMPSMKRFRKEEESEGAIW

SEQ ID NO: 4873 - protein, 3290 aa, Artificial Sequence
  derived and/or modified protein sequence (wt) from DENV-3__EU687218__SS-prME
TSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAVLPEEQDQNYVCKHTYVDRGWGNGCGLFGKGSLVTCAKFQCLEPIEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDVPCKIPFSTEDGQGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQADMGCVINWKGKELKCGSGIFVTNEVHTWTEKYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSASRAWNVWEVEDYGFGVFTTNIWLKLREVYTQLCDHRLMSAAVKDERAVHADMGYWIESQKNGSWKLEKASLIEVKTCTWPKSHTLWSNGVLESDMIIPKSLAGPISQHNYRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGKVDNFTMGVLCLAILFEEVMRGKFGKKHMIAGVFFTFVLLLSGQITWRDMAHTLIMIGSNASDRMGMGVTYLALIATFKIQPFLALGFFLRKLTSRENLLLGVGLAMATTLQLPEDIEQMANGIALGLMALKLITQFETYQLWTALISLTCSNTIFTLTVAWRTATLILAGVSLLPVCQSSSMRKTDWLPMTVAAMGVPPLPLFIFSLKDTLKRRSWPLNEGVMAVGLVSILASSLLRNDVPMAGPLVAGGLLIACYVITGTSADLTVEKAADVTWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTYNGKRLEPNWASVKKDLISYGGGWRLSAQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKDFAAGRKSIALDLVTEIGRVPSHLAHRTRNALDNLVMLHTSEHGGKAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVASVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRSMPGTRRVMGITAEWLWRTLGRNKKPRLCTREEFTKKVRTNAAMGAVFTEENQWDSAKAAVEDEDFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPTGTVMDIISRKDQRGSGQVGTYGLNTFTNMEAQLIRQMEGEGVLSKADLENPHLPEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLRETACLGKAYAQMWSLMYFHRRDLRLASNAICSAVPVHWVPTSRTTWSIHAHHQWMTTEDMLTVWNRVWIEDNPWMEDKTPVTTWENVPYLGKREDQWCGSLIGLTSRATWAQNIPTAIQQVRSLIGNEEFLDYMPSMKRFRKEEESEGAIW

SEQ ID NO: 4874 - protein, 3290 aa, Artificial Sequence
  derived and/or modified protein sequence (wt) from DENV-3__EU726772__SS-prME
TSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAVLPEEQDQNYVCKHTYVDRGWGNGCGLFGKGSLVTCAKFQCLEPIEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDVPCKIPFSTEDGQGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSASRAWNVWEVEDYGFGVFTTNIWLKLREVYTQLCDHRLMSAAVKDERAVHADMGYWIESQKNGSWKLEKASLIEVKTCTWPKSHTLWSNGVLESDMIIPKSLAGPISQHNYRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGKVDNFTMGVLCLAILFEEVMRGKFGKKHMIAGVFFTFVLLLSGQITWRDMAHTLIMIGSNASDRMGMGVTYLALIATFKIQPFLALGFFLRKLTSRENLLLGVGLAMATTLQLPEDIEQMANGIALGLMALKLITQFETYQLWTALISLTCSNTIFTLTVAWRTATLILAGVSLLPVCQSSSMRKTDWLPMTVAAMGVPPLPLFIFSLKDTLKRRSWPLNEGVMAVGLVSILASSLLRNDVPMAGPLVAGGLLIACYVITGTSADLTVEKAADVTWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTYNGKRLEPNWASVKKDLISYGGGWRLSAQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKDFAAGRKSIALDLVTEIGRVPSHLAHRTRNALDNLVMLHTSEHGGKAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVASVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRSMPGTRRVMGITAEWLWRTLGRNKKPRLCTREEFTKKVRTNAAMGAVFTEENQWDSAKAAVEDEDFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPTGTVMDIISRKDQRGSGQVGTYGLNTFTNMEAQLIRQMEGEGVLSKADLENPHLPEKKITQWLETKGVERLKRMAISGDDCVVKPIDDRFANALLALNDMGKGRKDIPQWQPSKGWHDWQQVPFCSHHFHELIMKDGRKLVVPCRPQDELIGRARISQGAGWSLRETACLGKAYAQMWSLMYFHRRDLRLASNAICSAVPVHWVPTSRTTWSIHAHHQWMTTEDMLTVWNRVWIEDNPWMEDKTPVTTWENVPYLGKREDQWCGSLIGLTSRATWAQNIPTAIQQVRSLIGNEEFLDYMPSMKRFRKEEESEGAIW

SEQ ID NO: 4875 - protein, 3290 aa, Artificial Sequence
  derived and/or modified protein sequence (wt) from DENV-3__FJ182013__SS-prME
TSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYVGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAVLPEEQDQNYVCKHTYVDRGWGNGCGLFGKGSLVTCAKFQCLEPIEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDVPCKIPFSTEDGQGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSASRAWNVWEVEDYGFGVFTTNIWLKLREVYTQLCDHRLMSAAVKDERAVHADMGYWIESQKNGSWKLEKASLIEVKTCTWPKSHTLWSNGVLESDMIIPKSLAGPISQHNYRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGKVDNFTMGVLCLAILFEEVMRGKFGKKHMIAGVFFTFVLLLSGQITWRDMAHTLIMIGSNASDRMGMGVTYLALIATFKIQPFLALGFFLRKLTSRENLLLGVGLAMATTLQLPEDIEQMANGIALGLMALKLITQFETYQLWTALISLTCSNTIFTLTVAWRTATLILAGVSLLPVCQSSSMRKTDWLPMAVAAMGVPPLPLFIFSLKDTLKRRSWPLNEGVMAVGLVSILASSLLRNDVPMAGPLVAGGLLIACYVITGTSADLTVEKAADVTWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTYNGKRLEPNWASVKKDLISYGGGWRLSAQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKDFAAGRKSIALDLVTEIGRVPSHLAHRTRNALDNLVMLHTSEHGGKAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVASVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRSMPGTRRVMGITAEWLWRTLGRNKKPRLCTREEFTKKVRTNAAMGAVFTEENQWDSAKAAVEDEDFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPTGTVMDIISRKDQRGSGQVGTYGLNTFTNMEAQLIRQMEGEGVLSKADLENPHLPEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLRETACLGKAYAQMWSLMYFHRRDLRLASNAICSAVPVHWVPTSRTTWSIHAHHQWMTTEDMLTVWNRVWIEDNPWMEDKTPVTTWENVPYLGKREDQWCGSLIGLTSRATWAQNIPTAIQQVRSLIGNEEFLDYMPSMKRFRKEEESEGAIW

SEQ ID NO: 4876 - protein, 3290 aa, Artificial Sequence
  derived and/or modified protein sequence (wt) from DENV-3__EU781136__SS-prME
TSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAVLPEEQDQNYVCKHTYVDRGWGNGCGLFGKGSLVTCAKFQCLEPIEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDVPCKIPFSTEDGQGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQADMGCVVNWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSASRAWNVWEVEDYGFGVFTTNIWLKLREVYTQLCDHRLMSAAVKDERAVHADMGYWIESQKNGSWKLEKASLIEVKTCTWPKSHTLWSNGVLESDMIIPKSLAGPISQHNYRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGKVDNFTMGVLCLAILFEEVMRGKFGKKHMIAGVFFTFVLLLSGQITWRDMAHTLIMIGSNASDRMGMGVTYLALIATFKIQPFLALGFFLRKLTSRENLLLGVGLAMATTLQLPEDIEQMANGIALGLMALKLITQFETYQLWTALISLTCSNTIFTLTVAWRTATLILAGVSLLPVCQSSSMRKTDWLPMTVAAMGVPPLPLFIFSLKDTLKRRSWPLNEGVMAVGLVSILASSLLRNDVPMAGPLVAGGLLIACYVITGTSADLTVEKAADVTWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTYNGKRLEPNWASVKKDLISYGGGWRLSAQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKDFAAGRKSIALDLVTEIGRVPSHLAHRTRNALDNLVMLHTSEHGGKAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVASVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRSMPGTRRVMGITAEWLWRTLGRNKKPRLCTREEFTKKVRTNAAMGAVFTEENQWDSAKAAVEDEDFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPTGTVMDIISRKDQRGSGQVGTYGLNTFTNMEAQLIRQMEGEGVLSKADLENPHLPEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLRETACLGKAYAQMWSLMYFHRRDLRLASNAICSAVPVHWVPTSRTTWSIHAHHQWMTTEDMLTVWNRVWIEDNPWMEDKTPVTTWENVPYLGKREDQWCGSLIGLTSRATWAQNIPTAIQQVRSLIGNEEFLDYMPSMKRFRKEEESEGAIW

SEQ ID NO: 4877 - protein, 3290 aa, Artificial Sequence
  derived and/or modified protein sequence (wt) from DENV-3__EU781137__SS-prME
TSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFTLLMLVTPSMTMRCVGVGNRDFVEGLSGATWVDVVLEHGGCVTTMAKNKPTLDIELQKTEATQLATLRKLCIEGKITNITTDSRCPTQGEAVLPEEQDQNYVCKHTYVDRGWGNGCGLFGKGSLVTCAKFQCLEPIEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDVPCKIPFSTEDGQGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSASRAWNVWEVEDYGFGVFTTNIWLKLREVYTQLCDHRLMSAAVKDERAVHADMGYWIESQKNGSWKLEKASLIEVKTCTWPKSHTLWSNGVLESDMIIPKSLAGPISQHNYRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGKVDNFTMGVLCLAILFEEVMRGKFGKKHMIAGVFFTFVLLLSGQITWRDMAHTLIMIGSNASDRMGMGVTYLALIATFKIQPFLALGFFLRKLTSRENLLLGVGLAMATTLQLPEDIEQMANGIALGLMALKLITQFETYQLWTALISLTCSNTIFTLTVAWRTATLILAGVSLLPVCQSSSMRKTDWLPMTVAAMGVPPLPLFIFSLKDTLKRRSWPLNEGVMAVGLVSILASSLLRNDVPMAGPLVAGGLLIACYVITGTSADLTVEKAADVTWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTYNGKRLEPNWASVKKDLISYGGGWRLSAQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKDFAAGRKSIALDLVTEIGRVPSHLAHRTRNALDNLVMLHTSEHGGKAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVASVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRSMPGTRRVMGITAEWLWRTLGRNKKPRLCTREEFTKKVRTNAAMGAVFTEENQWDSAKAAVEDEDFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPTGTVMDIISRKDQRGSGQVGTYGLNTFTNMEAQLIRQMEGEGVLSKADLENPHLPEKKITQWLETKGVERLKRMAISGDDCVVKPIDDRFANALLALNDMGKVRKDIPQWQPSKGWHDWQQVPFCSHHFHELVMKDGRKLVVPCRPQDELIGRARISQGAGWSLRETACLGKAYAQMWSLMYFHRRDLRLASNAICSAVPVHWVPTSRTTWSIHAHHQWMTTEDMLTVWNRVWIEDNPWMEDKTPVTTWENVPYLGKREDQWCGSLIGLTSRATWAQNIPTAIQQVRSLIGNEEFLDYMPSMKRFRKEEESEGAIW

SEQ ID NO: 4878 - protein, 3290 aa, Artificial Sequence
  derived and/or modified protein sequence (wt) from DENV-3__EU726773__SS-prME
TSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAVLPEEQDQNYVCKHTYVDRGWGNGCGLFGKGSLVTCAKFQCLEPIEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDVPCKIPFSTEDGQGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIVIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSASRAWNVWEVEDYGFGVFTTNIWLKLREVYTQLCDHRLMSAAVKDERAVHADMGYWIESQKNGSWKLEKASLIEVKTCTWPKSHTLWSNGVLESDMIIPKSLAGPISQHNYRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGKVDNFTMGVLCLAILFEEVMRGKFGKKHMIAGVFFTFVLLLSGQITWRDMAHTLIMIGSNASDRMGMGVTYLALIATFKIQPFLALGFFLRKLTSRENLLLGVGLAMATTLQLPEDIEQMANGIALGLMALKLITQFETYQLWTALISLTCSNTIFTLTVAWRTATLILAGVSLLPVCQSSSMRKTDWLPMTVAAMGVPPLPLFIFSLKDTLKRRSWPLNEGVMAVGLVSILASSLLRNDVPMAGPLVAGGLLIACYVITGTSADLTVEKAADVTWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTYNGKRLEPNWASVKKDLISYGGGWRLSAQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEEKDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKDFAAGRKSIALDLVTEIGRVPSHLAHRTRNALDNLVMLHTSEHGGKAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVASVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRSMPGTRRVMGITAEWLWRTLGRNKKPRLCTREEFTKKVRTNAAMGAVFTEENQWDSAKAAVEDEDFWILVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPTGTVMDIISRKDQRGSGQVGTYGLNTFTNMEAQLIRQMEGEGVLSKADLENPHLPEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLRETACLGKAYAQMWSLMYFHRRDLRLASNAICSAVPVHWVPTSRTTWSIHAHHQWMTTEDMLTVWNRVWIEDNPWMEDKTPVTTWENVPYLGKREDQWCGSLIGLTSRATWAQNIPTAIQQVRSLIGNEEFLDYMPSMKRFRKEEESEGAIW

SEQ ID NO: 4879 - protein, 3290 aa, Artificial Sequence
  derived and/or modified protein sequence (wt) from DENV-3__EU726774__SS-prME
TSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAVLPEEQDQNYVCKHTYVDRGWGNGCGLFGKGSLVTCAKFQCLEPIEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDVPCKIPFSTEDGQGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDTIGVLEQGKRTLTPQPMELKYSWKTWGKAKIVTAETQNSSFIIDGPNTPECPSASRAWNVWEVEDYGFGVFTTNIWLKLREVYTQLCDHRLMSAAVKDERAVHADMGYWIESQKNGSWKLEKASLIEVKTCTWPKSHTLWSNGVLESDMIIPKSLAGPISQHNYRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGKVDNFTMGVLCLAILFEEVMRGKFGKKHMIAGVFFTFVLLLSGQITWRDMAHTLIMVGSNASDRMGMGVTYLALIATFKIQPFLALGFFLRKLTSRENLLLGVGLAMATTLQLPEDIEQMANGIALGLMALKLTTQFETYQLWTALISLTCSNTIFTLTVAWRTATLILAGVSLLPVCQSSSMRKTDWLPMTVAAMGVPPLPLFIFSLKDTLKRRSWPLNEGVMAVGLVSILASSLLRNDVPMAGPLVAGGLLIACYVITGTSADLTVEKAADVTWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTYNGKRLEPNWASVKKDLISYGGGWRLSAQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKDFAAGRKSIALDLVTEIGRVPSHLAHRTRNALDNLVMLHTSEHGGKAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVASVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRSMPGTRRVMGITAEWLWRTLGRNKKPRLCTREEFTKKVRTNAAMGAVFTEENQWDSAKAAVEDEDFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPTGTVMDIISRKDQRGSGQVGTYGLNTFTNMEAQLIRQMEGEGVLSKADLENPHLPEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLRETACLGKAYAQMWSLMYFHRRDLRLASNAICSAVPVHWVPTSRTTWSIHAHHQWMTTEDMLTVWNRVWIEDNPWMEDKTPVTTWENVPYLGKREDQWCGSLIGLTSRATWAQNIPTAIQQVRSLIGNEEFLDYMPSMKRFRKEEESEGAIW

SEQ ID NO: 4880 - protein, 3290 aa, Artificial Sequence
  derived and/or modified protein sequence (wt) from DENV-3__EU687219__SS-prME
TSLCLMMILPAALAFHLTSRDGEPRMIVGKNERGKSLLFKTASGINMCTLIAMDLGEMCDDTVTYKCPHIAEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAVLPEEQDQNYVCKHTYVDRGWGNGCGLFGKGSLVTCAKFQCLEPIEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDVPCKIPFSTEDGQGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSVSRAWNVWEVEDYGFGVFTTNIWLKLREVYTQLCDHRLMSAAVKDERAVHADMGYWIESQKNGSWKLEKASLIEVKTCTWPKSHTLWSNGVLESDMIIPKSLAGPISQHNYRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGKVDNFTMGVLCLAILFEEVMRGKFGKKHMIAGVFFTFVLLLSGQITWRDMAHTLIMIGSNASDRMGMGVTYLALIATFKIQPFLALGFFLRKLTSRENLLLGVGLAMATTLQLPEDIEQMANGIALGLMALKLITQFETYQLWTALISLTCSNTIFTLTVAWRTATLILAGVSLLPVCQSSSMRKTDWLPMTVAAMGVPPLPLFIFSLKDTLKRRSWPLNEGVMAVGLVSILASSLLRNDVPMAGPLVAGGLLIACYVITGTSADLTVEKAADVTWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTYNGKRLEPNWASVKKDLISYGGGWRLSAQWQKGEEVQVIAVEPGKNPKNFQTMPGTFQTTTGEIGAIALDFKPGTSGSPIINREGKVVGLYGNGVITKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKDFAAGRKSIALDLVTEIGRVPSHLAHRTRNALDNLVMLHTSEHGGKAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVASVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRSMPGTRRVMGITAEWLWRTLGRNKKPRLCTREEFTKKVRTNAAMGAVFTEENQWDSAKAAVEDEDFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPTGTVMDIISRKDQRGSGQVGTYGLNTFTNMEAQLIRQMEGEGVLSKADLENPHLPEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLRETACLGKAYAQMWSLMYFHRRDLRLASNAICSAVPVHWVPTSRTTWSIHAHHQWMTTEDMLTVWNRVWIEDNPWMEDKTPVTTWENVPYLGKREDQWCGSLIGLTSRATWAQNIPTAIQQVRSLIGNEEFLDYMPSMKRFRKEEESEGAIW

SEQ ID NO: 4881 - protein, 3290 aa, Artificial Sequence
  derived and/or modified protein sequence (wt) from DENV-3__EU726768__SS-prME
TSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAVLPEEQDQNYVCKHTYVDRGWGNGCGLFGKGSLVTCAKFQCLEPIEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDVPCKIPFSTEDGQGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIVIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSASRAWNVWEVEDYGFGVFTTNIWLKLREVYTQLCDHRLMSAAVKDERAVHADMGYWIESQKNGSWKLEKASLIEVKTCTWPKSHTLWSNGVLESDMIIPKSLAGPISQHNYRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGKVDNFTMGVLCLAILFEEVMRGKFGKKHMIAGVFFTFVLLLSGQITWRDMAHTLIMIGSNASDRMGMGVTYLALIATFKIQPFLALGFFLRKLTSRENLLLGVGLAMATTLQLPEDIEQMANGIALGLMALKLITQFETYQLWTALISLTCSNTIFTLTVAWRTATLILAGVSLLPVCQSSSMRKTDWLPMTVAAMGVPPLPLFIFSLKDTLKRRSWPLNEGVMAVGLVSILASSLLRNDVPMAGPLVAGGLLIACYVITGTSADLTVEKAADVTWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTYNGKRLEPNWASVKKDLISYGGGWRLSAQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKDFAAGRKSIALDLVTEIGRVPSHLAHRTRNALDNLVMLHTSEHGGKAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVASVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRSMPGTRRVMGITAEWLWRTLGRNKKPRLCTREEFTKKVRTNAAMGAVFTEENQWDSAKAAVEDEDFWILVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPTGTVMDIISRKDQRGSGQVGTYGLNTFTNMEAQLIRQMEGEGVLSKADLENPHLPEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLRETACLGKAYAQMWSLMYFHRRDLRLASNAICSAVPVHWVPTSRTTWSIHAHHQWMTTEDMLTVWNRVWIEDNPWMEDKTPVTTWENVPYLGKREDQWCGSLIGLTSRATWAQNIPTAIQQVRSLIGNEEFLDYMPSMKRFRKEEESEGAIW

SEQ ID NO: 4882 - protein, 3290 aa, Artificial Sequence
  derived and/or modified protein sequence (wt) from DENV-3__EU687226__SS-prME
TSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAVLPEEQDQNYVCKHTYVDRGWGNGCGLFGKGSLVTCAKFQCLEPIEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDVPCKIPFSTEDGQGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSASRAWNVWEVEDYGFGVFTTNIWLKLREVYTQLCDHRLMSAAVKDERAVHADMGYWIESQKNGSWKLEKASLIEVKTCTWPKSHTLWSNGVLESDMIIPKSLAGPISQHNYRPGYHTQTAGPWHLGKLELDFNYCEGTTVVITENCGTRGPSLRTTTVSGKLIHEWCCRSCTLPPLRYMGEDGCWYGMEIRPVSEKEENMVKSLVSAGSGKVDNFTMGVLCLAILFEEVMRGKFGKKHMIAGVFFTFVLLLSGQITWRDMAHTLIMIGSNASDRMGMGVTYLALIATFKIQPFLALGFFLRKLTSRENLLLGVGLAMATTLQLPEDIEQMANGIALGLMALKLITQFETYQLWTALISLTCSNTIFTLTVAWRTATLILAGVSLLPVCQSSSMRKTDWLPMTVAAMGVPPLPLFIFSLKDTLKRRSWPLNEGVMAVGLVSILASSLLRNDVPMAGPLVAGGLLIACYVITGTSADLTVEKAADVTWEEEAEQTGVSHNLMITVDDDGTMRIKDDETENILTVLLKTALLIVSGIFPYSIPATLLVWHTWHKQTQRSGVPWDVPSPPETQKAELEEGVYRIKQQGIFGKTQVGVGVQKEGVFHSMWHVTRGAVLTYNGKRLEPNWASVKKDLISYGGGWRLSAQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKDFAAGRKSIALDLVTEIGRVPSHLAHRTRNALDNLVMLHTSEHGGKAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVASVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRSMPGTRRVMGITAEWLWRTLGRNKKPRLCTREEFTKKVRTNAAMGAVFTEENQWDSAKAAVEDEDFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPTGTVMDIISRKDQRGSGQVGTYGLNTFTNMEAQLIRQMEGEGVLSKADLENPHLPEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLRETACLGKAYAQMWSLMYFHRRDLRLASNAICSAVPVHWVPTSRTTWSIHAHHQWMTTEDMLTVWNRVWIEDNPWMEDKTPVTTWENVPYLGKREDQWCGSLIGLTSRATWAQNIPTAIQQVRSLIGNEEFLDYMPSMKRFRKEEESEGAIW

SEQ ID NO: 4883 - protein, 3291 aa, Artificial Sequence
  derived and/or modified protein sequence (wt) from DENV-3__EU687233__SS-prME
TSLCLMMILPAALAFHLTSRDGEPRMIVGKNERGKSLLFKTASGINMCTLIAMDLGEMCDDTVTYKCPHIAEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAVLPEEQDQNYVCKHTYVDRGWGNGCGLFGKGSLVTCAKFQCLEPIEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDVPCKIPFSTEDGQGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQADTGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSASRAWNVWEVEDYGFGVFTTNIWLKLREVYTQLCDHRLMSAAVKDERAVHADMGYWIESQKNGSWKLEKASLIEVKTCTWPKSHTLWSNGVLESDMIIPKSLAGPISQHNYRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGKVDNFTMGVLCLAILFEEVMRGKFGKKHMIAGVFFTFVLLLSGQITWRDMAHTLIMIGSNASDRMGMGVTYLALIATFKIQPFLALGFFLRKLTSRENLLLGVGLAMATTLQLPEDIEQMANGIALGLMALKLITQFETYQLWTALISLTCSNTIFTLTVAWRTATLILAGVSLLPVCQSSSMRKSDWLPMTVAAMGVPPLPLFIFSLKDTLKRRSWPLNEGVMAVGLVSILASSLLRNDVPMAGPLVAGGLLIACYVITGTSADLTVEKAADVTWEEEAEQTGVSHNLMITVDDDGTMRIKDDETENILTVLLKTALLIVSGIFPYSIPATLLVWHTWQKQTRRSGVLWDVPSPPETQKAELEEGVYRIKQQGIFGKTQVGVGVQKEGVFHTMWHVTRGAVLTYNGKRLEPNWASVKKDLISYGGGWRLSAQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKDFAAGRKSIALDLVTEIGRVPSHLAHRTRNALDNLVMLHTSEHGGKAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVASVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRSMPGTRRVMGITAEWLWRTLGRNKKPRLCTREEFTKKVRTNAAMGAVFTEENQWDSAKAAVEDEDFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPTGTVMDIISRKDQRGSGQVGTYGLNTCHSNMEAQLIRQMEGEGVLSKADLENPHLSEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLRETACLGKAYAQMWSLMYFHRRDLRLASNAICSAVPVHWVPTSRTTWSIHAHHQWMTTEDMLTVWNRVWIEDNPWMEDKTPVTTWENVPYLGKREDQWCGSLIGLTSRATWAQNIPTAIQQVRSLIGNEEFLDYMPSMKRFRKEEESEGAIW

SEQ ID NO: 4884 - protein, 3290 aa, Artificial Sequence
  derived and/or modified protein sequence (wt) from DENV-3__EU687234__SS-prME
TSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAVLPEEQDQNYVCKHTYVDRGWGNGCGLFGKGSLVTCAKFQCLEPIEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDVPCKVPFSTEDGQGKAHSGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIVIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSASRAWNVWEVEDYGFGVFTTNIWLKLREVYTQLCDHRLMSAAVKDERAVHADMGYWIESQKNGSWKLEKASLIEVKTCTWPKSHTLWSNGVLESDMIIPKSLAGPISQHNYRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGKVDNFTMGVLCLAILFEEVMRGKFGKKHMIAGVFFTFVLLLSGQITWRDMAHTLIMIGSNASDRMGMGVTYLALIATFKIQPFLALGFFLRKLTSRENLLLGVGLAMATTLQLPEDIEQMANGIALGLMALKLITQFETYQLWTALISLTCSNTIFTLTVAWRTATLILAGVSLLPVCQSSSMRKTDWLPMTVAAMGVPPLPLFIFSLKDTLKRRSWPLNEGVMAVGLVSILASSLLRNDVPMAGPLVAGGLLIACYVITGTSADLTVEKAADVTWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTYNGKRLEPNWASVKKDLISYGGGWRLSAQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKDFAAGRKSIALDLVTEIGRVPSHLAHRTRNALDNLVMLHTSEHGGRAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVASVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRSMPGTRRVMGITAEWLWRTLGRNKKPRLCTREEFTKKVRTNAAMGAVFTEENQWDSAKAAVEDEDFWILVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLASAIFKLTYQNKVVKVQRPTPTGTVMDIISRKDQRGSGQVGTYGLNTFTNMEAQLIRQMEGEGVLSKADLENPHLPEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLRETACLGKAYAQMWSLMYFHRRDLRLASNAICSAVPVHWVPTSRTTWSIHAHHQWMTTEDMLTVWNRVWIEDNPWMEDKTPVTTWENVPYLGKREDQWCGSLIGLTSRATWAQNIPTAIQQVRSLIGNEEFLDYMPSMKRFRKEEESEGAIW

SEQ ID NO: 4885 - protein, 3290 aa, Artificial Sequence
  derived and/or modified protein sequence (wt) from DENV-3__EU687196__SS-prME
TSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAVLPEEQDQNYVCKHTYVDRGWGNGCGLFGKGSLVTCAKFQCLEPIEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDVPCKIPFSTEDGQGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDTIGVLEQGKRTLTPQPMELKYSWKTWGKAKIVTAETQNSSFIIDGPNTPECPSASRAWNVWEVEDYGFGVFTTNIWLKLREVYTQLCDHRLMSAAVKDERAVHADMGYWIESQKNGSWKLEKASLIEVKTCTWPKSHTLWSNGVLESDMIIPKSLAGPISQHNYRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGKVDNFTMGVLCLAILFEEVMRGKFGKKHMIAGVIFTFVLLLSGQITWRDVAHTLIMIGSNASDRMGMGVTYLALIATFKIQPFLALGFFLRKLTSRENLLLGVGLAMATTLQLPEDIEQMANGIALGLMALKLTTQFETYQLWTALISLTCSNTIFTLTVAWRTATLILAGVSLLPVCQSSSMRKTDWLPMTVAAMGVPPLPLFIFSLKDTLKRRSWPLNEGVMAVGLVSILASSLLRNDVPMAGPLVAGGLLIACYVITGTSADLTVEKAADVTWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTYNGKRLEPNWASVKKDLISYGGGWRLSAQWQKGEEVQVIAVEPGKNPKNFQTMPGIFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKDFAAGRKSIALDLVTEIGRVPSHLAHRTRNALDNLVMLHMSEHGGKAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTVRVLKMVEPWLKNNQFCIKVLNPYMPTVIEHLERLQRKHGGMLVRNPLSRNSTHEMYWISNGTGNIVASVNMVSRLLLNRFTMTHRRPTIEKDVDLGAGTRHVNAEPETPNMDVIGERIKRIKEEHISTWHYDDENPYKTWAYHGSYEVKATGSASSMINGVVKLLTKPWDVVPMVTQMAMTDTTPFGQQRVFKEKVDTRTPRSMPGTRRVMGITAEWLWRTLGRNKKPRLCTREEFTKKVRTNAAMGAVFTEENQWDSAKAAVEDEDFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPTGTVMDIISRKDQRGSGQVGTYGLNTFTNMEAQLIRQMEGEGVLSKADLENPHLPEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSFRETACLGKAYAQMWSLMYFHRRDLRLASNAICSAVPVHWVPTSRTTWSIHAHHQWMTTEDMLTVWNRVWIEDNPWMEDKTPVTTWENVPYLGKREDQWCGSLIGLTSRATWAQNIPTAIQQVRSLIGNEEFLDYMPSMKRFRKEEESEGAIW

SEQ ID NO: 4886 - protein, 3290 aa, Artificial Sequence
  derived and/or modified protein sequence (wt) from DENV-3__EU854298__SS-prME
TSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAVLPEEQDQNYVCKHTYVDRGWGNGCGLFGKGSLVTCAKFQCLEPIEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDVPCKIPFSTEDGQGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPNASRAWNVWEVEDYGFGVFTTNIWLKLREVHTQLCDHRLMSAAVKDERAVHADMGYWIESQKNGSWKLEKASLIEVKTCTWPKSHTLWSNGVLESDMIIPKSLAGPISQHNYRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGKVDNFTMGVLCLAILFEEVMRGKFGKKHMIAGVFFTFVLLLSGQITWRDMAHTLIMIGSNASDRMGMGVTYLALIATFKIQPFLALGFFLRKLTSRENLLLGVGLAMATTLQLPEDIEQMANGIALGLMALKLITQFETYQLWTALISLTCSNTIFTLTVAWRTATLILAGVSLLPVCQSSSMRKTDWLPMTVAAMGVPPLPLFIFSLKDTLKRRSWPLNEGVMAVGLVSILASSLLRNDVPMAGPLVAGGLLIACYVITGTSADLTVEKAADVTWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLAYNGKRLEPNWASVKKDLISYGGGWRLSAQWQKGEEVQVIAVEPGKNPKNFQTIPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGERKKLRPRWLDARTYSDPLALKEFKDFAAGRKSIALDLVTEIGRVPSHLAHRTRNALDNLVMLHTSEHGGKAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVASVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRSMPGTRRVMGITAEWLWRTLGRNKKPRLCTREEFTKKVRTNAAMGAVFTEENQWDSAKAAVEDEDFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPTGTVMDIISRKDQRGSGQVGTYGLNTFTNMEVQLIRQMEGEGVLSKADLENPHLPEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLRETACLGKAYAQMWSLMYFHRRDLRLASNAICSAVPVHWVPTSRTTWSIHAHHQWMTTEDMLTVWNRVWIEDNPWMEDKTPVTTWENVPYLGKREDQWCGSLIGLTSRATWAQNIPTAIHQVRSLIGNEEFLDYMPSMKRFRKEEELEGAIW

SEQ ID NO: 4887 - protein, 3290 aa, Artificial Sequence
  derived and/or modified protein sequence (wt) from DENV-3__FJ373306__SS-prME
TSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYVGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAVLPEEQDQNYVCKHTYVDRGWGNGCGLFGKGSLVTCAKFQCLEPIEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDVPCKVPFSTEDGQGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIVIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSASRAWNVWEVEDYGFGVFSTNIWLKLREVYTQLCDHRLMSAAVKDERAVHADMGYWIESQKNGSWKLEKASLIEVKTCTWPKSHTLWSNGVLESDMIIPKSLAGPISQHNYRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGKVDNFTMGVLCLAILFEEVMRGKFGKKHMIAGVFFTFVLLLSGQITWRDMAHTLIMIGSNASDRMGMGVTYLALIATFKIQPFLALGFFLRKLTSRENLLLGVGLAMATTLQLPEDIEQMANGIALGLMALKLITQFETYQLWTALISLTCSNTIFTLTVAWRTATLILAGVSLLPVCQSSSMRKTDWLPMTVAAMGVPPLPLFIFSLKDTLKRRSWPLNEGVMAVGLVSILASSLLRNDVPMAGPLVAGGLLIACYVITGTSADLTVEKAADVTWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTYNGKRLEPNWASVKKDLISYGGGWRLSAQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKDFAAGRKSIALDLVTEIGRVPSHLAHRTRNALDNLVMLHTSEHGGKAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVASVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRSMPGTRRVMGITAEWLWRTLGRNKKPRLCTREEFTKKVRTNAAMGAVFTEENQWDSAKAAVEDEDFWILVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPTGTVMDIISRKDQRGSGQVGTYGLNTFTNMEAQLIRQMEGEGVLSKADLENPHLPEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLRETACLGKAYAQMWSLMYFHRRDLRLASNAICSAVPVHWVPTSRTTWSIHAHHQWMTTEDMLTVWNRVWIEDNPWMEDKTPVTTWENVPYLGKREDQWCGSLIGLTSRATWAQNIPTAIQQVRSLIGNEEFLDYMPSMKRFRKEEESEGAIW

SEQ ID NO: 4888 - protein, 3290 aa, Artificial Sequence
  derived and/or modified protein sequence (wt) from DENV-3__EU687197__SS-prME
TSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAVLPEEQDQNYVCKHTYVDRGWGNGCGLFGKGSLVTCAKFQCLEPIEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDVPCKIPFSTEDGQGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQADMGCVVNWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPNASRAWNVWEVEDYGFGVFTTNIWLKLREVYTQLCDHRLMSAAVKDERAVHADMGYWIESQKNGSWKLEKASLIEVKTCTWPKSHTLWSNGVLESDMIIPKSLAGPISQHNYRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGKVDNFTMGVLCLAILFEEVMRGKFGKKHMIAGVFFTFVLLLSGQITWRDMAHTLIMIGSNASDRMGMGVTYLALIATFKIQPFLALGFFLRKLTSRENLLLGVGLAMATTLQLPEDIEQMANGIALGLMALKLITQFETYQLWTALISLTCSNTIFTLTVAWRTATLILAGVSLLPVCQSSSMRKTDWLPMTVAAMGVPPLPLFIFSLKDTLKRRSWPLNEGVMAVGLVSILASSLLRNDVPMAGPLVAGGLLIACYVITGTSADLTVEKAADVTWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLAYNGKRLEPNWASVKKDLISYGGGWRLSAQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGRTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGERKKLRPRWLDARTYSDPLALKEFKDFAAGRKSIALDLVTEIGRVPSHLAHRTRNALDNLVMLHTSEHGGKAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVASVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRSMPGTRRVMGITAEWLWRTLGRNKKPRLCTREEFTKKVRTNAAMGAVFTEENQWDSAKAAVEDEDFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPTGTVMDIISRKDQRGSGQVGTYGLNTFTNMEVQLIRQMEGEGVLSKADLENPHLPEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLRETACLGKAYAQMWSLMYFHRRDLRLASNAICSAVPVHWVPTSRTTWSIHAHHQWMTTEDMLTVWNRVWIEDNPWMEDKTPVTTWENVPYLGKREDQWCGSLIGLTSRATWAQNIPTAIHQVRSLIGNEEFLDYMPSMKRFRKEEELEGAIW

SEQ ID NO: 4889 - protein, 3290 aa, Artificial Sequence
  derived and/or modified protein sequence (wt) from DENV-3__EU687198__SS-prME
TSLCLMMILPAALAFHLTSRDGEPRMIVGKNERGKSLLFKTASGINMCTLIAMDLGEMCDDTVTYKCPHIAEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAVLPEEQDQNYVCKHTYVDRGWGNGCGLFGKGSLVTCAKFQCLEPIEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDVPCKIPFSTEDGQGKAHNGRLITANPVVTKKEEPVNIEAEPPFGESNIVIGVGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQADTGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSASRAWNVWEVEDYGFGVFTTNIWLKLREVYTQLCDHRLMSAAVKDERAVHADMGYWIESQKNGSWKLEKASLIEVKTCTWPKSHTLWSNGVLESDMIIPKSLAGPISQHNYRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGKVDNFTMGVLCLAILFEEVMRGKFGKKHMIAGVFFTFVLLLSGQITWRDMAHTLIMIGSNASDRMGMGVTYLALIATFKIQPFLALGFFLRKLTSRENLLLGVGLAMATTLQLPEDIEQMANGIALGLMALKLITQFETYQLWTALISLTCSNTIFTLTVAWRTATLILAGVSLLPVCQSSSMRKSDWLPMTVAAMGVPPLPLFIFSLKDTLKRRSWPLNEGVMAVGLVSILASSLLRNDVPMAGPLVAGGLLIACYVITGTSADLTVEKAADVTWEEEAEQTGVSHNLMITVDDDGTMRIKDDETENILTVLLKTALLIVSGIFPYSIPATLLVWHTWQKQTRRSGVLWDVPSPPETQKAELEEGVYRIKQQGIFGKTQVGVGVQKEGVFHTMWHVTRGAVLTYNGKRLEPNWASVKKDLISYGGGWRLSAQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTRLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKDFAAGRKSIALDLVTEIGRVPSHLAHRTRNALDNLVMLHTSEHGGKAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVASVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRSMPGTRRVMGITAEWLWRTLGRNKKPRLCTREEFTKKVRTNAAMGAVFTEENQWDSAKAAVEDEDFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPTGTVMDIISRKDQRGSGQVGTYGLNTFTNMEAQLIRQMEGEGVLSKADLENPHLSEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLRETACLGKAYAQMWSLMYFHRRDLRLASNAICSAVPVHWVPTSRTTWSIHAHHQWMTTEDMLTVWNRVWIEDNPWMEDKTPVTTWENVPYLGKREDQWCGSLIGLTSRATWAQNIPTAIQQVRSLIGNEEFLDYMPSMKRFRKEEESEGAIW

SEQ ID NO: 4890 - protein, 3290 aa, Artificial Sequence
  derived and/or modified protein sequence (wt) from DENV-3__EU726769__SS-prME
TSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAVLPEEQDQNYVCKHTYVDRGWGNGCGLFGKGSLVTCAKFQCLEPIEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDVPCKIPFSTEDGQGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIVIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSASRAWNVWEVEDYGFGVFTTNIWLKLREVYTQLCDHRLMSAAVKDERAVHADMGYWIESQKNGSWKLEKASLIEVKTCTWPKSHTLWSNGVLESDMIIPKSLAGPISQHNYRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGKVDNFTMGVLCLAILFEEVMRGKFGKKHMVAGVFFTFVLLLSGQITWRDMAHTLIMVGSNASDRMGMGVTYLALIATFKIQPFLALGFFLRKLTSRENLLLGVGLAMATTLQLPEDIEQMANGIALGLMALKLITQFETYQLWTALISLTCSNTIFTLTVAWRTATLILAGVSLLPVCQSSSMRKTDWLPMTVAAMGVPPLPLFIFSLKDTLKRRSWPLNEGVMAVGLVSILASSLLRNDVPMAGPLVAGGLLIACYVITGTSADLTVEKAADVTWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTYNGKRLEPNWASVKKDLISYGGGWRLSAQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKDFAAGRKSIALDLVTEIGRVPSHLAHRTRNALDNLVMLHTSEHGGKAYRHAVEELPETMETLLLLGLMILLTGGAMLFLISGKGIGKTSIGLICVIASSGMLWIAEIPLQWIASAIVLEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVASVNMVSRLLLNRFTMTYRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRSMPGTRRVMGITAEWLWRTLGRNKKPRLCTREEFTKKVRTNAAMGAVFTEENQWDSAKAAVEDEDFWILVDRERELHKVGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPTGTVMDIISRKDQRGSGQVGTYGLNTFTNMEAQLIRQMEGEGVLSKADLENPHLPEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLRETACLGKAYAQMWSLMYFHRRDLRLASNAICSAVPVHWVPTSRTTWSIHAHHQWMTTEDMLTVWNRVWIEDNPWMEDKTPVTTWENVPYLGKREDQWCGSLIGLTSRATWAQNIPTAIQQVRSLIGNEEFLDYMPSMKRFRKEEESEGAIW

SEQ ID NO: 4891 - protein, 3290 aa, Artificial Sequence
  derived and/or modified protein sequence (wt) from DENV-3__EU687239__SS-prME
TSLCLMMILPAALAFHLTSRDGEPRMIVGKNERGKSLLFKTASGINMCTLIAMDLGEMCDDTVTYKCPHIAEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAVLPEEQDQNYVCKHTYVDRGWGNGCGLFGKGSLVTCAKFQCLEPIEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDVPCKIPFSTEDGQGKAHNGRLITANPVVTKKEEPVNIEAEPPFGESNIVIGVGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQADTGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSASRAWNVWEVEDYGFGVFTTNIWLKLREVYTQLCDHRLMSAAVKDERAVHADMGYWIESQKNGSWKLEKASLIEVKTCTWPKSHTLWSNGVLESDMIIPKSLAGPISQHNYRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGKVDNFTMGVLCLAILFEEVMRGKFGKKHMIAGVFFTFVLLLSGQITWRDMAHTLIMIGSNASDRMGMGVTYLALIATFKIQPFLALGFFLRKLTSRENLLLGVGLAMATTLQLPEDIEQMANGIALGLMALKLITQFETYQLWTALISLTCSNTIFTLTVAWRTATLILAGVSLLPVCQSSSMRKSDWLPMTVAAMGVPPLPLFIFSLKDTLKRRSWPLNEGVMAVGLVSILASSLLRNDVPMAGPLVAGGLLIACYVITGTSADLTVEKAADVTWEEEAEQTGVSHNLMITVDDDGTMRIKDDETENILTVLLKTALLIVSGIFPYSIPATLLVWHTWQKQTRRSGVLWDVPSPPETQKAELEEGVYRIKQQGIFGKTQVGVGVQKEGVFHTMWHVTRGAVLTYNGKRLEPNWASVKKDLISYGGGWRLSAQWQKGEEVQVIAVEPGKNPKNFQTMPGTFQTTTGEIGAVALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKDFAAGRKSIALDLVTEIGRVPSHLAHRTRNALDNLVMLHTSEHGGKAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVASVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRSMPGTRRVMGITAEWLWRTLGRNKKPRLCTREEFTKKVRTNAAMGAVFTEENQWDSAKAAVEDEDFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPTGTVMDIISRKDQRGSGQVGTYGLNTFTNMEAQLIRQMEGEGVLSKADLENPHLSEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLRETACLGKAYAQMWSLMYFHRRDLRLASNAICSAVPVHWVPTSRTTWSIHAHHQWMTTEDMLTVWNRVWIEDNPWMEDKTPVTTWENVPYLGKREDQWCGSLIGLTSRATWAQNIPTAIQQVRSLIGNEEFLDYMPSMKRFRKEEESEGVIW

SEQ ID NO: 4892 - protein, 3290 aa, Artificial Sequence
  derived and/or modified protein sequence (wt) from DENV-3__FJ182004__SS-prME
TSLCLMMILPAALAFHLTSRDGEPRMIVGKNERGKSLLFKTASGINMCTLIAMDLGEMCDDTVTYKCPHIAEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAVLPEEQDQNYVCKHTYVDRGWGNGCGLFGKGSLVTCAKFQCLEPIEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDAPCKIPFSTEDGQGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQADTGCVINWKGKELKCGSGIFVTNEVHTWTEQYKFQADSPKRLATAIAGAWENGVCGIRSTTRMENLLWKQVANELNYILWENNIKLTVVVGDIIGVLEQGKRTLTPQPMELKYSWKTWGKAKIVTAETQNSSFIIDGPNTPECPSASRAWNVWEVEDYGFGVFTTNIWLKLREVYTQLCDHRLMSAAVKDERAVHADMGYWIESQKNGSWKLEKASLIEVKTCTWPKSHTLWSNGVLESDMIIPKSLAGPISQHNYRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGKVDNFTMGVLCLAILFEEVMRGKFGKKHMIAGVFFTFVLLLSGQITWRDMAHTLIMIGSNASDRMGMGVTYLALIATFKIQPFLALGFFLRKLTSRENLLLGVGLAMATTLQLPEDIEQMANGIALGLMALKLITQFETYQLWTALISLTCSNTIFTLTVAWRTATLILAGVSLLPVCQSSSMRKSDWLPMTVAAMGVPPLPLFIFSLKDTLKRRSWPLNEGVMAVGLVSILASSLLRNDVPMAGPLVAGGLLIACYVITGTSADLTVEKAADVTWEEEAEQTGVSHNLMITVDDDGTMRIKDDETENILTVLLKTALLIVSGIFPYSIPATLLVWHTWQKQTRRSGVLWDVPSPPETQKAELEEGVYRIKQQGIFGKTQVGVGVQKEGVFHTMWHVTRGAVLTYNGKRLEPNWASVKKDLISYGGGWRLSAQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKDFAAGRKSIALDLVTEIGRVPSHLAHRTRNALDNLVMLHTSEHGGKAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVASVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRSMPGTRRVMGITAEWLWRTLGRNKKPRLCTREEFTKKVRTNAAMGAVFTEENQWDSAKAAVEDEDFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPTGTVMDIISRKDQRGSGQVGTYGLNTFTNMEAQLIRQMEGEGVLTKADLENPHLSEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLRETACLGKAYAQMWSLMYFHRRDLRLASNAICSAVPVHWVPTSRTTWSIHAHHQWMTTEDMLTVWNRVWIEDNPWMEDKTPVTTWENVPYLGKREDQWCGSLIGLTSRATWAQNIPTAIQQVRSLIGNEEFLDYMPSMKRFRKEEESEGAIW

SEQ ID NO: 4893 - protein, 3290 aa, Artificial Sequence
  derived and/or modified protein sequence (wt) from DENV-3__FJ024465__SS-prME
TSLCLMMILPAALAFHLTSRDGEPRMIVGKNERGKSLLFKTASGINMCTLIAMDLGEMCDDTVTYKCPHIAEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAVLPEEQDQNYVCKHTYVDRGWGNGCGLFGKGSLVTCAKFQCLEPIEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDVPCKIPFSTEDGQGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQADTGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSASRAWNVWEVEDYGFGVFTTNIWLKLREVYTQLCDHRLMSAAVKDERAVHADMGYWIESQKNGSWKLEKASLIEVKTCTWPKSHTLWSNGVLESDMIIPKSLAGPISQHNYRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGKVDNFTMGVLCLAILFEEVMRGKFGKKHMIAGVFFTFVLLLSGQITWRDMAHTLIMIGSNASDRMGMGVTYLALIATFKIQPFLALGFFLRKLTSRENLLLGVGLAMATTLQLPEDIEQMANGIALGLMALKLITQFETYQLWTALISLTCSNTIFTLTVAWRTATLILAGVSLLPVCQSSSMRKSDWLPMTVAAMGVPPLPLFIFSLKDTLKRRSWPLNEGVMAVGLVSILASSLLRNDVPMAGPLVAGGLLIACYVITGTSADLAVEKAADVTWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTYNGKRLEPNWASVKKDLISYGGGWRLSAQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKDFAAGRKSIALDLVTEIGRVPSHLAHRTRNALDNLVMLHTSEHGGKAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVASVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPTVTQMAMTDTTPFGQQRVFKEKVDTRTPRSMPGTRRVMGITAEWLWRTLGRNKKPRLCTREEFTKKVRTNAAMGAVFTEENQWDSAKAAVEDEDFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPTGTVMDIISRKDQRGSGQVGTYGLNTFTNMEAQLIRQMEGEGVLSKADLENSHLSEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLRETACLGKAYAQMWSLMYFHRRDLRLASNAICSAVPVHWVPTSRTTWSIHAHHQWMTTEDMLTVWNRVWIEDNPWMEDKTPVTTWENVPYLGKREDQWCGSLIGLTSRATWAQNIPTAIQQVRSLIGNEEFLDYMPSMKRFRKEEESEGAIW

SEQ ID NO: 4894 - protein, 3290 aa, Artificial Sequence
  derived and/or modified protein sequence (wt) from DENV-3__FJ024466__SS-prME
TSLCLMMILPAALAFHLTSRDGEPRMIVGKNERGKSLLFKTASGINMCTLIAMDLGEMCDDTVTYKCPHIAEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAVLPEEQDQNYVCKHTYVDRGWGNGCGLFGKGSLVTCAKFQCLEPIEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDAPCKIPFSTEDGQGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQADTGCVINWKGKELKCGSGIFVTNEVHTWTEQYRFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSASRAWNVWEVEDYGFGVFTTNIWLKLREVYTQLCDHRLMSAAVKDERAVHADMGYWIESQKNGSWKLEKASLIEVKTCTWPKSHTLWSNGVLESDMIIPKSLAGPISQHNYRPGYHTQTAGPWHLGKLELDFNYCEGTTVVITDNCGTRGPSLRTTTVSGKLIHEWCCRSCTLPPLRYMGEDGCWYGMEIRPISEKEENMVKSLVSAGSGKVDNFTMGVLCLAILFEEVMRGKFGKKHMIAGVFFTFVLLLSGQITWRDMAHTLIMIGSNASDRMGMGVTYLALIATFKIQPFLALGFFLRKLTSRENLLLGVGLAMATTLQLPEDIEQMANGIALGLMALKLITQFETYQLWTALISLTCSNTIFTLTVAWRTATLILAGVSLLPVCQSSSMRKSDWLPMTVAAMGVPPLPLFIFSLKDTLKRRSWPLNEGVMAVGLVSILASSLLRNDVPMAGPLVAGGLLIACYVITGTSADLTVEKAADVTWEEEAEQTGVSHNLMITVDDDGTMRIKDDETENILTVLLKTALLIVSGIFPYSIPATLLVWHTWQKQTRRSGVLWDVPSPPETQKAELEEGVYRIKQQGIFGKTQVGVGVQKEGVFHTMWHVTRGAVLTYNGKRLEPNWASVKKDLISYGGGWRLSAQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKDFAAGRKSIALDLVTEIGRVPSHLAHRTRNALDNLVMLHTSEHGGKAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVASVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRSMPGTRRVMGITAEWLWRTLGRNKKPRLCTREEFTKKVRTNAAMGAVFTEENQWDSAKAAVEDEDFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITHQMDPEHRQLANAIFKLTYQNKVVKVQRPTPTGTVMDIISRKDQRGSGQVGTYGLNTFTNMEAQLIRQMEGEGVLSKADLENPHLSEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLRETACLGKAYAQMWSLMYFHRRDLRLASNAICSAVPVHWVPTSRTTWSIHAHHQWMTTEDMLTVWNRVWIEDNPWMEDKTPVTTWENVPYLGKREDQWCGSLIGLTSRATWAQNIPTAIQQVRSLIGNEEFLDYMPSMKRFRKEEESEGAIW

SEQ ID NO: 4895 - protein, 3290 aa, Artificial Sequence
  derived and/or modified protein sequence (wt) from DENV-3__FJ024467__SS-prME
TSLCLMMVLPAALAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAVLPEEQDQNYVCKHTYVDRGWGNGCGLFGKGSLVTCAKFQCLEPIEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDAPCKIPFSTEDGQGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGVITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSASRAWNVWEVEDYGFGVFTTNIWLKLREVYTQLCDHRLMSAAVKDERAVHADMGYWIESQKNGSWKLEKASLIEVKTCTWPKSHTLWSNGVLESDMIIPKSLAGPISQHNHRPGYQTQTAGPWHLGKLELDFNYCEGTTVVITENCGTRGPSLRTTTVSGKLIHEWCCRSCTLPPLRYMGEDGCWYGMEIRPISEKEENMVKSLVSAGSGKVDNFTMGVLCLAILFEEMMRGKFGKKHMIAGVFFTFVLLLSGQITWRDMAHTLIMIGSNASDRMGMGVTYLALIAAFKIQPFLALGFFLRKLTSRENLLLGVGLAMATTLQLPEDIEQMANGIALGLMALKLITQFETYQLWTALISLTCSNTMFTLTVAWRTATLILAGVSLLPVCQSSSMRKTDWLPMAVAAMGVPPLPLFIFSLKDTLKRRSWPLNEGVMAVGLVSILASSLLRNDVPMAGPLVAGGLLIACYVITGTSADLTVEKAADITWEEEAEQTGVSHNLMITVDDDGTMRIKDDETENILTVLLKTALLIVSGVFPYSIPATLLVWHTWQKQTQRSGVLWDVPSPPETQKAELEEGVYRIKQQGIFGKTQVGVGVQKEGVFHTMWHVTRGAVLTYNGKRLEPNWASVKKDLISYGGGWRLSAQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEEKDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKDFAAGRKSIALDLVTEIGRVPSHLAHRTRNALDNLVMLHTSEHGGRAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGETTHHAVSRGTAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVASVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRSMPGTRRAMGITAEWLWRTLGRNKKPRLCTREEFTKKVRTNAAMGAVFTEENQWDSAKAAVEDENFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPTGTVMDIISRKDQRGSGQVGTYGLNTFTNMEAQLIRQMEGEGVLSKADLENPHLPEKKITQWLETKGVERLRRMAISGDDCVVKPIDDRFANALLALNDMGKVRKDIPQWQPSKGWHDWQQVPFCSHHFHELIMKDGRKLVVPCRPQDELIGRARISQGAGWSLRETACLGKAYAQMWSLMYFHRRDLRLASNAICSAVPVHWVPTSRTTWSIHAHHQWMTTEDMLTVWNRVWIEDNPWMEDKTPVTTWENVPYLGKREDQWCGSLIGLTSRATWAQNIPTAIQQVRSLIGNEEFLDYMPSMKRFRKEEESEGAIW

SEQ ID NO: 4896 - protein, 3290 aa, Artificial Sequence
  derived and/or modified protein sequence (wt) from DENV-3__FJ024468__SS-prME
TSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAVLPEEQDQNYVCKHTYVDRGWGNGCGLFGKGSLVTCAKFQCLEPIEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDAPCKIPFSTEDGQGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGVITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSASRAWNVWEVEDYGFGVFTTNIWLKLREVYTQLCDHRLMSAAVKDERAVHADMGYWIESQKNGSWKLEKASLIEVKTCTWPKSHTLWSNGVLESDMIIPKSLAGPISQHNYRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGKVDNFTMGVLCLAILFEEVMRGKFGKKHMIAGVFFTFVLLLSGQITWRDMAHTLIMIGSNASDKMGMGVTYLALIATFKIQPFLALGFFLRKLTSRENLLLGVGLAMATTLQLPEDIEQMANGIALGLMALKLITQFETYQLWTALISLTCSNTMFTLTVAWRTATLILAGVSLLPVCQSSSMRKTDWLPMAVAAMGVPPLPLFIFSLKDTLKRRSWPLNEGVMAVGLVSILASSLLRNDVPMAGPLVAGGLLIACYVITGTSADLTVEKAADITWEEEAEQTGVSHNLMITVDDDGTMRIKDDETENILTVLLKTALLIVSGVFPYSIPATLLVWHTWQKQTQRSGVLWDVPSPPETQKAELEEGVYRIKQQGIFGKTQVGVGVQKEGVFHTMWHVTRGAVLTYNGKRLEPNWASVKKDLISYGGGWRLSAQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKDFAAGRKSIALDLVTEIGRVPSHLAHRTRNALDNLVMLHTSEHGGRAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGETTHHAVSRGTAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVASVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRSMPGTRRVMGITAEWLWRTLGRNKKPRLCTREEFTKKVRTNAAMGAVFTEENQWDSAKAAVEDEDFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPTGTVMDIISRKDQRGSGQVGTYGLNTFTNMEAQLIRQMEGEGVLSKADLENPHLPEKKITQWLETKGVERLRRMAISGDDCVVKPIDDRFANALLALNDMGKVRKDIPQWQPSKGWHDWQQVPFCSHHFHELIMKDGRKLVVPCRPQDELIGRARISQGAGWSLRETACLGKAYAQMWSLMYFHRRDLRLASNAICSAVPVHWVPTSRTTWSIHAHHQWMTTEDMLTVWNRVWIEDNPWMEDKTPVTTWENVPYLGKREDQWCGSLIGLTSRATWAQNIPTAIQQVRSLIGNEEFLDYMPSMKRFRKEEESEGAIW

SEQ ID NO: 4897 - protein, 3290 aa, Artificial Sequence
  derived and/or modified protein sequence (wt) from DENV-3__FJ024470__SS-prME
TSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAALPEEQDQNYVCKHTYVDRGWGNGCGLFGKGSLVTCAKFQCLEPIEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDVPCKIPFSTEDGQGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSASRAWNVWEVEDYGFGVFTTNIWLKLREVYTQLCDHRLMSAAVKDERAVHADMGYWIESQKNGSWKLEKASLIEVKTCTWPKSHTLWSNGVLESDMIIPKSLAGPISQHNHRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGKVDNFTMGVLCLAILFEEVMRGKFGKKHMIAGVFFTFVLLLSGQITWRDMAHTLIMIGSNASDRMGMGVTYLALIATFKIQPFLALGFFLRKLTSRENLLLGVGLAMATTLQLPEDIEQMANGIALGLMALKLITQFETYQLWTALISLTCSNTIFTLTVAWRTATLILAGVSLLPVCQSSSMRKTDWLPMAVAAMGVPPLPLFIFSLKDTLKRRSWPLNEGVMAVGLVSILASSLLRNDVPMAGPLVAGGLLIACYVITGTSADLTVEKAADITWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTYNGKRLEPNWASVKKDLISYGGGWRLSAQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKDFAAGRKSIALDLVTEIGRVPSHLAHRTRNALDNLVMLHTSEHGGRAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVASVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRSMPGTRRVMGITAEWLWRTLGRNKKPRLCTREEFTKKVRTNAAMGAVFTEENQWDSAKAAVEDEDFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPTGTVMDIISRKDQRGSGQVGTYGLNTFTNMEAQLIRQMEGEGVLSKADLESHHLPEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLRETACLGKAYAQMWSLMYFHRRDLRLASNAICSAVPVHWVPTSRTTWSIHAHHQWMTTEDMLTVWNRVWIEDNPWMEDKTPVTTWENVPYLGKREDQWCGSLIGLTSRATWAQNIPTAIQQVRSLIGNEEFLDYMPSMKRFRKEEESEGAIW

SEQ ID NO: 4898 - protein, 3290 aa, Artificial Sequence
  derived and/or modified protein sequence (wt) from DENV-3__FJ024471__SS-prME
TSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAALPEEQDQNYVCKHTYVDRGWGNGCGLFGKGSLVTCAKFQCLEPIEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDVPCKIPFSTEDGQGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSASRAWNVWEVEDYGFGVFTTNIWLKLREVYTQLCDHRLMSAAVKDERAVHADMGYWIESQKNGSWKLEKASLIEVKTCTWPKSHTLWSNGVLESDMIIPKSLAGPISQHNHRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGKVDNFTMGVLCLAILFEEVMRGKFGKKHMIAGVFFTFVLLLSGQITWRDMAHTLIMIGSNASDRMGMGVTYLALIATFKIQPFLALGFFLRKLTSRENLLLGVGLAMATTLQLPEDIEQMANGIALGLMALKLITQFETYQLWTALISLTCSNTIFTLTVAWRTATLILAGVSLLPVCQSSSMRKTDWLPMAVAAMGVPPLPLFIFSLKDTLKRRSWPLNEGVMAVGLVSILASSLLRNDVPMAGPLVAGGLLIACYVITGTSADLTVEKAADITWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTYNGKRLEPNWASVKKDLISYGGGWRLSAQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFNTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKDFAAGRKSIALDLVTEIGRVPSHLAHRTRNALDNLVMLHTSEHGGRAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVASVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRSMPGTRRVMGITAEWLWRTLGRNKKPRLCTREEFTKKVRTNAAMGAVFTEENQWDSAKAAVEDEDFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPTGTVMDIISRKDQRGSGQVGTYGLNTFTNMEAQLIRQMEGEGVLSKADLESHHLSEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLRETACLGKAYAQMWSLMYFHRRDLRLASNAICSAVPVHWVPTSRTTWSIHAHHQWMTTEDMLTVWNRVWIEDNPWMEDKTPVTTWENVPYLGKREDQWCGSLIGLTSRATWAQNIPTAIQQVRSLIGNEEFLDYMPSMKRFRKEEESEGAIW

SEQ ID NO: 4899 - protein, 3290 aa, Artificial Sequence
  derived and/or modified protein sequence (wt) from DENV-3__FJ182005__SS-prME
TSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAVLPEEQDQNYVCKHTYVDRGWGNGCGLFGKGSLVTCAKFQCLEPIEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDVPCKVPFSTEDGQGKAHSGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGILLTWIGLNSKNTSMSFSCIVIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKAWGKAKIVTAETQNSSFIIDGPNTPECPSASRAWNVWEVEDYGFGVFTTNIWLKLREVYTQLCDHRLMSAAVKDERAVHADMGYWIESQKNGSWKLEKASLIEVKTCTWPKSHTLWSNGVLESDMIIPKSLAGPISQHNYRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGKVDNFTMGVLCLAILFEEVMRGKFGKKHMIAGVFFTFVLLLSGQITWRDMAHTLIMIGSNASDRMGMGVTYLALIATFKIQPFLALGFFLRKLTSRENLLLGVGLAMATTLQLPEDIEQMANGIALGLMALKLITQFETYQLWTALISLTCSNTIFTLTVAWRTATLILAGVSLLPVCQSSSMRKTDWLPMTVAAMGVPPLPLFIFSLKDTLKRRSWPLNEGVMAVGLVSILASSLLRNDVPMAGPLVAGGLLIACYVITGTSADLTVEKAADVTWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTYNGKRLEPNWASVKKDLISYGGGWRLSAQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKDFAAGRKSIALDLVTEIGRVPSHLAHRTRNALDNLVMLHTSEHGGRAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVASVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRSMPGTRRVMGITAEWLWRTLGRNKKPRLCTREEFTKKVRTNAAMGAVFTEENQWDSAKAAVEDEDFWILVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLASAIFKLTYQNKVVKVQRPTPTGTVMDIISRKDQRGSGQVGTYGLNTFTNMEAQLIRQMEGEGVLSKADLENPHLPEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLRETACLGKAYAQMWSLMYFHRRDLRLASNAICSAVPVHWVPTSRTTWSIHAHHQWMTTEDMLTVWNRVWIEDNPWMEDKTPVTTWENVPYLGKREDQWCGSLIGLTSRATWAQNIPTAIQQVRSLIGNEEFLDYMPSMKRFRKEEESEGAIW

SEQ ID NO: 4900 - protein, 3290 aa, Artificial Sequence
  derived and/or modified protein sequence (wt) from DENV-3__FJ373302__SS-prME
TSLCLMMILPAALAFHLTSRDGEPRMIVGKNERGKSLLFKTASGINMCTLIAMDLGEMCDDTVTYKCPHIAEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAVLPEEQDQNYVCKHTYVDRGWGNGCGLFGKGSLVTCAKFQCLEPIEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDAPCKIPFSTEDGQGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQADTGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSASRAWNVWEVEDYGFGVFTTNIWLKLREAYTQLCDHRLMSAAVKDERAVHADMGYWIESQKKGSWKLEKASLIEVKTCTWPKSHTLWSNGVLESDMIIPKSLAGPISQHNYRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGKVDNFTMGVLCLAILFEEVMRGKFGKKHMIAGVFFTFVLLLSGQITWRDMAHTLIMIGSNASDRMGMGVTYLALIATFKIQPFLALGFFLRKLTSRENLLLGVGLAMATTLQLPEDIEQMANGIALGLMALKLITQFETYQLWTALISLTCSNTIFTLTVAWRTATLILAGVSLLPVCQSSSMRKSDWLPMTVAAMGVPPLPLFIFSLKDTLKRRSWPLNEGVMAVGLVSILASSLLRNDVPMAGPLVAGGLLIACYVITGTSADLTVEKAADVTWEEEAEQTGVSHNLMITVDDDGTMRIKDDETENILTVLLKTALLIVSGIFPYSIPATLLVWHTWQKQTRRSGVLWDVPSPPETQKAELEEGVYRIKQQGIFGKTQVGVGVQKEGVFHTMWHVTRGAVLTYNGKRLEPNWASVKKDLISYGGGWRLSAQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKDFAAGRKSIALDLVTEIGRVPSHLAHRTRNALDNLVMLHTSEHGGKAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSKGETLGEKWKKKLNQLSRKEFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVASVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRSMPGTRRVMGITAEWLWRTLGRNKKPRLCTREEFTKKVRTNAAMGAVFTEENQWDSAKAAVEDEDFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPTGTVMDIISRKDQRGSGQVGTYGLNTFTNMEAQLIRQMEGEGVLSKADLENPHLSEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLRETACLGKAYAQMWSLMYFHRRDLRLASNAICSAVPVHWVPTSRTTWSIHAHHQWMTTEDMLTVWNRVWIEDNPWMEDKTPVTTWENVPYLGKREDQWCGSLIGLTSRATWAQNIPTAIQQVRSLIGNEEFLDYMPSMKRFRKEEESEGAIW

SEQ ID NO: 4901 - protein, 3290 aa, Artificial Sequence
  derived and/or modified protein sequence (wt) from DENV-3__FJ182007__SS-prME
TSLCLMMILPAALAFHLTSRDGEPRMIVGKNERGKSLLFKTASGINMCTLIAMDLGEMCDDTVTYKCPHIAEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAVLPEEQDQNYVCKHTYVDRGWGNGCGLFGKGSLVTCAKFQCLEPIEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDAPCKIPFSTEDGQGKAHNGRLITANPVVTKKEEPVNIEAEPPFGESNIVIGTGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQADTGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSASRAWNVWEVEDYGFGVFTTNIWLKLREVYTQLCDHRLMSAAVKDERAVHADMGYWIESQKNGSWKLEKASLIEVKTCTWPKSHTLWSNGVLESDMIIPKSLAGPISQHNYRPGYHTQTAGPWHLGKLELDFNYCEGTTVVITEDCGTRGPSLRTTTVSGKLIHEWCCRSCTLPPLRYMGEDGCWYGMEIRPISEKEENMVKSLVSAGSGKVDNFTMGVLCLAILFEEVMRGKFGKKHMIAGVFFTFVLLLSGQITWRDMAHTLIMIGSNASDRMGMGVTYLALIATFKIQPFLALGFFLRKLTSRENLLLGVGLAMATTLQLPEDIEQMANGIALGLMALKLITQFETYQLWTALISLTCSNTIFTLTVAWRTATLILAGVSLLPVCQSSSMRKSDWLPMTVAAMGVPPLPLFIFSLKDTLKRRSWPLNEGVMAVGLVSILASSLLRNDVPMAGPLVAGGLLIACYVITGTSADLTVEKAADVTWEEEAEQTGVSHNLMITVDDDGTMRIKDDETENILTVLLKTALLIVSGIFPYSIPATLLVWHTWQKQTRRSGVLWDVPSPPETQKAELEEGVYRIKQQGIFGKTQVGVGVQKEGVFHTMWHVTRGAVLTYNGKRLEPNWASVKKDLISYGGGWRLSAQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKDFAAGRKSIALDLVTEIGRVPSHLAHRTRNALDNLVMLHTSEHGGKAYRHAVEELPETMETLLLLGLMILLTGGAMLFLISGKGIGKTSIGLICVIASSGMLWIAEIPLQWIASAIVLEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKRKLNQLSRKEFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVASVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRSMPGTRRVMGITAEWLWRTLGRNKKPRLCTREEFTKKVRTNAAMGAVFTEENQWDSAKAAVEDEDFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPTGTVMDIISRKDQRGSGQVGTYGLNTFTNMEAQLIRQMEGEGVLSKADLENPHLSEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLRETACLGKAYAQMWSLMYFHRRDLRLASNAICSAVPVHWVPTSRTTWSIHAHHQWMTTEDMLTVWNRVWIEDNPWMEDKTPVTTWENVPYLGKREDQWCGSLIGLTSRATWAQNIPTAIQQVRSLIGNEEFLDYMPSMKRFRKEEESEGAIW

SEQ ID NO: 4902 - protein, 3290 aa, Artificial Sequence
  derived and/or modified protein sequence (wt) from DENV-3__FJ182008__SS-prME
TSLCIMMILPAALAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAVLPEEQDQNYVCKHTYVDRGWGNGCGLFGKGSLVTCAKFQCLEPIEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDAPCKIPFSTEDGQGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGVITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSASRAWNVWEVEDYGFGVFTTNIWLKLREVYTQLCDHRLMSAAVKDERAVHADMGYWIESQKNGSWKLEKASLIEVKTCTWPKSHTLWSNGVLESDMIIPKSLAGPISQHNYRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGKVDNFTMGVLCLAILFEEVMRGKFGKKHMIAGVFFTFVLLLSGQITWRDMAHTLIMIGSNASDKMGMGVTYLALIATFKIQPFLALGFFLRKLTSRENLLLGVGLAMATTLQLPEDIEQMANGIALGLMALKLITQFETYQLWTALISLTCSNTMFTLTVAWRTATLILAGVSLLPVCQSSSMRKTDWLPMAVAAMGVPPLPLFIFSLKDTLKRRSWPLNEGVMAVGLVSILASSLLRNDVPMAGPLVAGGLLIACYVITGTSADLTVEKAADITWEEEAEQTGVSHNLMITVDDDGTMRIKDDETENILTVLLKTALLIISGVFPYSIPATLLVWHTWQKQTQRSGVLWDVPSPPETQKAELEEGVYRIKQQGIFGKTQVGVGVQKEGVFHTMWHVTRGAVLTYNGKRLEPNWASVKKDLISYGGGWRLSAQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKDFAAGRKSIALDLVTEIGRVPSHLAHRTRNALDNLVMLHTSEHGGRAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGETTHHAVSRGTAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVASVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRSMPGTRRVMGITAEWLWRTLGRNKKPRLCTREEFTKKVRTNAAMGAVFTEENQWDSAKAAVEDEDFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPTGTVMDIISRKDQRGSGQVGTYGLNTFTNMEAQLIRQMEGEGVLSKADLENPHLPEKKITQWLETKGVERLRRMAISGDDCVVKPIDDRFANALLALNDMGKVRKDIPQWQPSKGWHDWQQVPFCSHHFHELIMKDGRKLVVPCRPQDELIGRARISQGAGWSLRETACLGKAYAQMWSLMYFHRRDLRLASNAICSAVPVHWVPTSRTTWSIHAHHQWMTTEDMLTVWNRVWIEDNPWMEDKTPVTTWENVPYLGKREDQWCGSLIGLTSRATWAQNIPTAIQQVRSLIGNEEFLDYMPSMKRFRKEEESEGAIW

SEQ ID NO: 4903 - protein, 3290 aa, Artificial Sequence
  derived and/or modified protein sequence (wt) from DENV-3__FJ182010__SS-prME
TSLCLMMILPAALAFHLTSRDGEPRMIVGKNERGKSLLFKTASGINMCTLIAMDLGEMCDDTVTYKCPHIAEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFVLLMLVTPSMTMRCVGVGNRDFVEGLSGATWVDVVLEHGGCVTTMAKNKPTLDIELQKTEATQLATLRKLCIEGKITNITTDSRCPTQGEAVLPEEQDQNYVCKHTYVDRGWGNGCGLFGKGSLVTCAKFQCLEPIEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDAPCKIPFSTEDGQGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQADTGCVINWKGKELKCGSGIFVTNEVHTWTEQYKFQADSPKRLATAIAGAWENGVCGIRSTTRMENLLWKQVANELNYILWENNIKLTVVVGDIIGVLEQGKRTLTPQPMELKYSWKTWGKAKIVTAETQNSSFIIDGPNTPECPSASRAWNVWEVEDYGFGVFTTNIWLKLREVYTQLCDHRLMSAAVKDERAVHADMGYWIESQKNGSWKLEKASLIEVKTCTWPKSHTLWSNGVLESDMIIPKSLAGPISQHNYRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGKVDNFTMGVLCLAILFEEVMRGKFGKKHMIAGVFFTFVLLLSGQITWRDMAHTLIMIGSNASDRMGMGVTYLALIATFKIQPFLALGFFLRKLTSRENLLLGVGLAMATTLQLPEDIEQMANGIALGLMALKLITQFETYQLWTALISLTCSNTIFTLTVAWRTATLILAGVSLLPVCQSSSMRKSDWLPMTVAAMGVPPLPLFIFSLKDTLKRRSWPLNEGVMAVGLVSILASSLLRNDVPMAGPLVAGGLLIACYVITGTSADLTVEKAADVTWEEEAEQTGVSHNLMITVDDDGTMRIKDDETENILTVLLKTALLIVSGIFPYSIPATLLVWHTWQKQTRRSGVLWDVPSPPETQKAELEEGVYRIKQQGIFGKTQVGVGVQKEGVFHTMWHVTRGAVLTYNGKRLEPNWASVKKDLISYGGGWRLSAQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKDFAAGRKSIALDLVTEIGRVPSHLAHRTRNALDNLVMLHTSEHGGKAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVASVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRSMPGTRRVMGITAEWLWRTLGRNKKPRLCTREEFTKKVRTNAAMGAVFTEENQWDSAKAAVEDEDFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLADAIFKLTYQNKVVKVQRPTPTGTVMDIISRKDQRGSGQVGTYGLNTFTNMEAQLIRQMEGEGVLTKADLENPHLSEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLRETACLGKAYAQMWSLMYFHRRDLRLASNAICSAVPVHWVPTSRTTWSIHAHHQWMTTEDMLTVWNRVWIEDNPWMEDKTPVTTWENVPYLGKREDQWCGSLIGLTSRATWAQNIPTAIQQVRSLIGNEEFLDYMPSMKRFRKEEESEGAIW

SEQ ID NO: 4904 - protein, 3290 aa, Artificial Sequence
  derived and/or modified protein sequence (wt) from DENV-3__FJ182011__SS-prME
TSLCLMMILPAALAFHLTSRDGEPRMIVGKNERGKSLLFKTASGINMCTLIAMDLGEMCDDTVTYKCPHIAEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAVLPEEQDQNYVCKHTYVDRGWGNGCGLFGKGSLVTCAKFQCLEPIEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDAPCKIPFSTEDGQGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQADTGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSASRAWNVWEVEDYGFGVFTTNIWLKLREVYTQLCDHRLMSAAVKDERAVHADMGYWIESQKNGSWKLEKASLIEVKTCTWPKSHTLWSNGVLESDMIIPKSLAGPISQHNYRPGYHTQTAGPWHLGKLELDFNYCEGTTVVITDNCGTRGPSLRTTTVSGKLIHEWCCRSCTLPPLRYMGEDGCWYGMEIRPISEKEENMVKSLVSAGSGKVDNFTMGVLCLAILFEEVMRGKFGKKHMIAGVFFTFVLLLSGQITWRDMAHTLIMIGSNASDRMGMGVTYLALIATFKIQPFLALGFFLRKLTSRENLLLGVGLAMATTLQLPEDIEQMANGIALGLMALKLITQFETYQLWTALISLTCSNTIFTLTVAWRTATLILAGVSLLPVCQSSSMRKSDWLPMTVAAMGVPPLPLFIFSLKDTLKRRSWPLNEGVMAVGLVSILASSLLRNDVPMAGPLVAGGLLIACYVITGTSADLTVEKAADVTWEEEAEQTGVSHNLMITVDDDGTMRIKDDETENILTVLLKTALLIVSGIFPYSIPATLLVWHTWQKQTRRSGVLWDVPSPPETQKAELEEGVYRIKQQGIFGKTQVGVGVQKEGVFHTMWHVTRGAVLTYNGKRLEPNWASVKKDLISYGGGWRLSAQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKDFAAGRKSIALDLVTEIGRVPSHLAHRTRNALDNLVMLHTSEHGGKAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVASVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRSMPGTRRVMGITAEWLWRTLGRNKKPRLCTREEFTKKVRTNAAMGAVFTEENQWDSAKAAVEDEDFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITHQMDPEHRQLANAIFKLTYQNKVVKVQRPTPTGTVMDIISRKDQRGSGQVGTYGLNTFTNMEAQLIRQMEGEGVLSKADLENPHLSEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLRETACLGKAYAQMWSLMYFHRRDLRLASNAICSAVPVHWVPTSRTTWSIHAHHQWMTTEDMLTVWNRVWIEDNPWMEDKTPVTTWENVPYLGKREDQWCGSLIGLTSRATWAQNIPTAIQQVRSLIGNEEFLDYMPSMKRFRKEEESEGAIW

SEQ ID NO: 4905 - protein, 3290 aa, Artificial Sequence
  derived and/or modified protein sequence (wt) from DENV-3__FJ182038__SS-prME
TSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAVLPEEQDQNYVCKHTYVDRGWGNGCGLFGKGSLVTCAKFQCLEPIEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDAPCKIPFSTEDGQGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTTLFSGVSWVMKIGIGVLLTWIGLNSKNTSMSFSCIAIGVITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSASRAWNVWEVEDYGFGVFTTNIWLKLREVYTQLCDHRLMSAAVKDERAVHADMGYWIESQKNGSWKLEKASLIEVKTCTWPKSHTLWSNGVLESDMIIPKSLAGPISQHNYRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGKVDNFTMGVLCLAILFEEVMRGKFGKKHMIAGVFFTFVLLLSGQITWRDMAHTLIMIGSNASDKMGMGVTYLALIATFKIQPFLALGFFLRKLTSRENLLLGVGLAMATTLQLPEDIEQMANGIALGLMALKLITQFETYQLWTALISLTCSNTMFTLTVAWRTATLILAGVSLLPVCQSSSMRKTDWLPMAVAAMGVPPLPLFIFSLKDTLKRRSWPLNEGVMAVGLVSILASSLLRNDVPMAGPLVAGGLLIACYVITGTSADLTVEKAADITWEEEAEQTGVSHNLMITVDDDGTMRIKDDETENILTVLLKTALLIVSGVFPYSIPATLLVWHTWQKQTQRSGVLWDVPSPPETQKAELEEGVYRIKQQGIFGKTQVGVGVQKEGVFHTMWHVTRGAVLTYNGKRLEPNWASVKKDLISYGGGWRLSAQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFMGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKDFAAGRKSIALDLVTEIGRVPSHLAHRTRNALDNLVMLHTSEHGGRAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAATIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGETTHHAVSRGTAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVASVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRSMPGTRRVMGITAEWLWRTLGRNKKPRLCTREEFTKKVRTNAAMGAVFTEENQWDSAKAAVEDEDFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPTGTVMDIISRKDQRGSGQVGTYGLNTFTNMEAQLIRQMEGEGVLSKADLENPHLPEKKITQWLETKGVERLRRMAISGDDCVVKPIDDRFANALLALNDMGKVRKDIPQWQPSKGWHDWQQVPFCSHHFHELIMKDGRKLVVPCRPQDELIGRARISQGAGWSLRETACLGKAYAQMWSLMYFHRRDLRLASNAICSAVPVHWVPTSRTTWSIHAHHQWMTTEDMLTVWNRVWIEDNPWMEDKTPVTTWENVPYLGKREDQWCGSLIGLTSRATWAQNIPTAIQQVRSLIGNEEFLDYMPSMKRFRKEEESEGAIW

SEQ ID NO: 4906 - protein, 3290 aa, Artificial Sequence
  derived and/or modified protein sequence (wt) from DENV-3__FJ182041__SS-prME
TSLCLMMILPAALAFHLTSRDGEPRMIVGKNERGKSLLFKTASGINMCTLIAMDLGEMCDDTVTYKCPHIAEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAVLPEEQDQNYVCKHTYVDRGWGNGCGLFGKGSLVTCAKFQCLEPIEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDVPCKIPFSTEDGQGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQADTGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSASRAWNVWEVEDYGFGVFTTNIWLKLREVYTQLCDHRLMSAAVKDERAVHADMGYWIESQKNGSWKLEKASLIEVKTCTWPKSHTLWSNGVLESDMIIPKSLAGPISQHNYRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGKVDNFTMGVLCLAILFEEVMRGKFGKKHMIAGVFFTFVLLLSGQITWRDMAHTLIMIGSNASDRMGMGVTYLALIATFKIQPFLALGFFLRKLTSRENLLLGVGLAMATTLQLPEDIEQMANGIALGLMALKLITQFETYQLWTALISLTCSNTIFTLTVAWRTATLILAGVSLLPVCQSSSMRKSDWLPMTVAAMGVPPLPLFIFSLKDTLKRRSWPLNEGVMAVGLVSILASSLLRNDVPMAGPLVAGGLLIACYVITGTSADLTVEKAADVTWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTYNGKRLEPNWASVKKDLISYGGGWRLSAQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKDFAAGRKSIALDLVTEIGRVPSHLAHRTRNALDNLVMLHTSEHGGKAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGTQGETLGEKWKKKLNQLSRKEFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVASVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRSMPGTRRVMGITAEWLWRTLGRNKKPRLCTREEFTKKVRTNAAMGAVFTEENQWDSAKAAVEDEDFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPTGTVMDIISRKDQRGSGQVGTYGLNTFTNMEAQLIRQMEGEGVLSKADLENPHLSEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLRETACLGKAYAQMWSLMYFHRRDLRLASNAICSAVPVHWVPTSRTTWSIHAHHQWMTTEDMLTVWNRVWIEDNPWMEDKTPVTTWENVPYLGKREDQWCGSLIGLTSRATWAQNIPTAIQQVRSLIGNEEFLDYMPSMKRFRKEEESEGAIW

SEQ ID NO: 4907 - protein, 3290 aa, Artificial Sequence
  derived and/or modified protein sequence (wt) from DENV-3__FJ390371__SS-prME
TSLCLMMILPAALAFHLTSRDGEPRMIVGKNERGKSLLFKTASGINMCTLIAMDLGEMCDDTVTYKCPHIAEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAVLPEEQDQNYVCKHTYVDRGWGNGCGLFGKGSLVTCAKFQCLEPIEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDAPCKIPFSTEDGQGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQADTGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSASRAWNVWEVEDYGFGVFTTNIWLKLREVYTQLCDHRLMSAAVKDERAVHADMGYWIESQKNGSWKLEKASLIEVKTCTWPKSHTLWSNGVLESDMIIPKSLAGPISQHNYRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGKVDNFTMGVLCLAILFEEVMRGKFGKKHMIAGVFFTFVLLLSGQITWRDMAHTLIMIGSNASDRMGMGVTYLALIATFKIQPFLALGFFLRKLTSRENLLLGVGLAMATTLQLPEDIEQMANGIALGLMALKLITQFETYQLWTALISLTCSNTIFTLTVAWRTATLILAGVSLLPVCQSSSMRKSDWLPMTVAAMGVPPLPLFIFSLKDTLKRRSWPLNEGVMAVGLVSILASSLLRNDVPMAGPLVAGGLLIACYVITGTSADLTVEKAADVTWEEEAEQTGVSHNLMITVDDDGTMRIKDDETENILTVLLKTALLIVSGIFPYSIPATLLVWHTWQKQTRRSGVLWDVPSPPETQKAELEEGVYRIKQQGIFGKTQVGVGVQKEGVFHTMWHVTRGAVLTYNGKRLEPNWASVKKDLISYGGGWRLSAQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKDFAAGRKSIALDLVTEIGRVPSHLAHRTRNALDNLVMLHTSEHGGKAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVASVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRSMPGTRRVMGITAEWLWRTLGRNKKPRLCTREEFTKKVRTNAAMGAVFTEENQWDSAKAAVEDEDFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPTGTVMDIISRKDQRGSGQVGTYGLNTFTNMEAQLIRQMEGEGVLTKADLENPHLSEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLRETACLGKAYAQMWSLMYFHRRDLRLASNAICSAVPVHWVPTSRTTWSIHAHHQWMTTEDMLTVWNRVWIEDNPWMEDKTPVTTWENVPYLGKREDQWCGSLIGLTSRATWAQNIPTAIQQVRSLIGNEEFLDYMPSMKRFRKEEESEGAIW

SEQ ID NO: 4908 - protein, 3290 aa, Artificial Sequence
  derived and/or modified protein sequence (wt) from DENV-3__FJ390372__SS-prME
TSLCLMMVLPAALAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAVLPEEQDQNYVCKHTYVDRGWGNGCGLFGKGSLVTCAKFQCLEPIEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDAPCKIPFSTEDGQGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGVITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSASRAWNVWEVEDYGFGVFTTNIWLKLREVYTQLCDHRLMSAAVKDERAVHADMGYWIESQKNGSWKLEKASLIEVKTCTWPKSHTLWSNGVLESDMIIPKSLAGPISQHNHRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGKVDNFTMGVLCLAILFEEVMRGKFGKKHMIAGVFFTFVLLLSGQITWRDMAHTLIMIGSNASDRMGMGVTYLALIATFKIQPFLALGFFLRKLTSRENLLLGVGLAMATTLQLPEDIEQMANGIALGLMALKLITQFETYQLWTALISLTCSNTMFTLTVAWRTATLILAGVSLLPVCQSSSMRKTDWLPMAVAAMGVPPLPLFIFSLKDTLKRRSWPLNEGVMAVGLVSILASSLLRNDVPMAGPLVAGGLLIACYVITGTSADLTVEKAADITWEEEAEQTGVSHNLMITVDDDGTMRIKDDETENILTVLLKTALLIVSGVFPYSIPATLLVWHTWQKQTQRSGVLWDVPSPPETQKAELEEGVYRIKQQGIFGKTQVGVGVQKEGVFHTMWHVTRGAVLTYNGKRLEPNWASVKKDLISYGGGWRLSAQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEEKDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKDFAAGRKSIALDLVTEIGRVPSHLAHRTRNALDNLVMLHTSEHGGRAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGETTHHAVSRGTAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVASVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGHQRVFKEKVDTRTPRSMPGPRRAMGITAEWLWRTLGRNKKPRLCTREEFTKKGRTNAAMGAVFTEENQWDSAKAAVEDEDFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADATAGWDTRITEDDLHNEEKITQQMDPDHRQLATAIFKLTYQNKVVKVQRPTPTGTVMDIISRKDQRGSGQVGTYGLNTFTNMEAQLIRQMEGEGVLSKADLENPHLPEKKITQWLETKGVERLRRMAISGDDCVVKPIDDRFANALLALNDMGKVRKDIPQWQPSKGWHDWQQVPFCSHHFHELIMKDGRKLVVPCRPQDELIGRARISQGAGWSLRETACLGKAYAQMWSLMYFHRRDLRLASNAICSAVPVHWVPTSRTTWSIHAHHQWMTTEDMLTVWNRVWIEDNPWMEDKTPVTTWENVPYLGKREDQWCGSLIGLTSRATWAQNIPTAIQQVRSLIGNEEFLDYMPSMKRFRKEEESEGAIW

SEQ ID NO: 4909 - protein, 3290 aa, Artificial Sequence
  derived and/or modified protein sequence (wt) from DENV-3__FJ205870__SS-prME
TSLCLMMILPAALAFHLTSRDGEPRMIVGKNERGKSLLFKTASGINMCTLIAMDLGEMCDDTVTYKCPHIAEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAVLPEEQDQNYVCKHTYVDRGWGNGCGLFGKGSLVTCAKFQCLEPIEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDVPCKIPFSTEDGQGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQADTGCVINWKGKELKCGSGIFVTNEVHTWTEQYKFQADSPKRLATAIAGAWENGVCGIRSTTRMENLLWKQIANELNYILWENNIKLTVVVGDIIGILEQGKRTLTPQPMELKYSWKTWGKAKIVTAETQNSSFIIDGPNTPECPSASRAWNVWEVEDYGFGVFTTNIWLKLREVYTQLCDHRLMSAAVKDERAVHADMGYWIESQKNGSWKLEKASLIEVKTCTWPKSHTLWSNGVLESDMIIPKSLAGPISQHNYRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGKVDNFTMGVLCLAILFEEVMRGKFGKKHMIAGVFFTFVLLLSGQITWRDMAHTLIMIGSNASDRMGMGVTYLALIATFKIQPFLALGFFLRKLTSRENLLLGVGLAMATTLQLPEDIEQMANGIALGLMALKLITQFETYQLWTALISLTCSNTIFTLTVAWRTATLILAGVSILPVCQSSSMRKSDWLPMTVAAMGVPPLPLFIFSLKDTLKRRSWPLNEGVMAVGLVSILASSLLRNDVPMAGPLVAGGLLIACYVITGTSADLTVEKAADVTWEEEAEQTGVSHNLMITVDDDGTMRIKDDETENILTVLLKTALLIVSGIFPYSIPATLLVWHTWQKQTRRSGVLWDVPSPPETQKAELEEGVYRIKQQGIFGKTQVGVGVQKEGVFHTMWHVTRGAVLTYNGKRLEPNWASVKKDLISYGGGWRLSAQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKDFAAGRKSIALDLVTEIGRVPSHLAHRTRNALDNLVMLHTSEHGGKAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVASVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRSMPGTRRVMGITAEWLWRTLGRNKKPRLCTREEFTKKVRTNAAMGAVFTEENQWDSAKAAVEDEDFWKLVDRERELHKLGKCGSCVYNMMGKREKKLGEFGKAKGSRAIWYMWLGARYLEFEALGFLNEDHWFSRENSYSGVEGEGLPKLGYILRDISKIPGGAMYADDTAGWDTRITEDDLHNEEKITQQMDPEHRQLANAIFKLTYQNKVVKVQRPTPTGTVMDIISRKDQRGSGQVGTYGLNTFTNMEAQLIRQMEGEGVLSKADLENPHLSEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLRETACLGKAYAQMWSLMYFHRRDLRLASNAICSAVPVHWVPTSRTTWSIHAHHQWMTTEDMLTVWNRVWIEDNPWMEDKTPVTTWENVPYLGKREDQWCGSLIGLTSRATWAQNIPTAIQQVRSLIGNEEFLDYMPSMKRFRKEEESEGAIW

SEQ ID NO: 4910 - protein, 3290 aa, Artificial Sequence
  derived and/or modified protein sequence (wt) from DENV-3__FJ390373__SS-prME
TSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAVLPEEQDQNYVCKHTYVDRGWGNGCGLFGKGSLVTCAKFQCLEPIEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDVPCKIPFSTEDGRGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDTIGVLEQGKRTLTPQPMELKYSWKTWGKAKIVTAETQNSSFIIDGPNTPECPSASRAWNVWEVEDYGFGVFTTNIWLKLREVYTQLCDHRLMSAAVKDERAVHADMGYWIESQKNGSWKLEKASLIEVKTCTWPKSHTLWSNGVLESDMIIPKSLAGPISQHNYRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGKVDNFTMGVLCLAILFEEVMRGKFGKKHMIAGVFFTFVLLLSGQITWRDMAHTLIMIGSNASDRMGMGVTYLALIATFKIQPFLALGFFLRKLTSRENLLLGVGLAMATTLQLPEDIEQMANGIALGLMALKLTTQFETYQLWTALISLTCSNTIFTLTVAWRTATLILAGVSLLPVCQSSSMRKTDWLPMTVAAMGVPPLPLFIFSLKDTLKRRSWPLNEGVMAVGLVSILASSLLRNDVPMAGPLVAGGLLIACYVITGTSADLTVEKAADVTWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTYNGKRLEPNWASVKKDLISYGGGWRLSAQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGALPVWLAHKVASEGIKYTDRKWCFDGQRNNQILEENMDVEIWTKEGEKKKLRPRWLDARTYSDPLALKEFKDFAAGRKSIALDLVTEIGRVPSHLAHRTRNALDNLVMLHTSEHGGKAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVASVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRSMPGTRRVMGITAEWLWRTLGRNKKPRLCTREEFTKKVRTNAAMGAVFTEENQWDSAKAAVEDEDFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPTGTVMDIISRKDQRGSGQVGTYGLNTFTNMEAQLIRQMEGEGVLSKADLENPHLPEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLRETACLGKAYAQMWSLMYFHRRDLRLASNAICSAVPVHWVPTSRTTWSIHAHHQWMTTEDMLTVWNRVWIEDNPWMEDKTPVTTWENVPYLGKREDQWCGSLIGLTSRATWAQNIPTAIQQVRSLIGNEEFLDYMPSMKRFRKEEESEGAIW

SEQ ID NO: 4911 - protein, 3290 aa, Artificial Sequence
  derived and/or modified protein sequence (wt) from DENV-3__FJ205871__SS-prME
TSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAVLPEEQDQNYVCKHTYVDRGWGNGCGLFGKGSLVTCAKFQCLEPIEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDVPCKIPFSTEDGQGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDTIGVLEQGKRTLTPQPMELKYSWKTWGKAKIVTAETQNSSFIIDGPNTPECPSASRAWNVWEVEDYGFGVFTTNIWLKLREAYTQLCDHRLMSAAVKDERAVHADMGYWIESQKNGSWKLEKASLIEVKTCTWPKSHTLWSNGVLESDMIIPKSLAGPISQHNYRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGKVDNFTMGVLCLAILFEEVMRGKFGKKHMIAGVFFTFVLLLSGQITWRDMAHTLIMIGSNASDRMGMGVTYLALIATFKIQPFLALGFFLRKLTSRENLLLGVGLAMATTLQLPEDIEQMANGIALGLMALKLTTQFETYQLWTALISLTCSNTIFTLTVAWRTATLILAGVSLLPVCQSSSMRKTDWLPMTVAAMGVPPLPLFIFSLKDTLKRRSWPLNEGVMAVGLVSILASSLLRNDVPMAGPLVAGGLLIACYVITGTSADLTVEKAADVTWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTYNGKRLEPNWASVKKDLISYGGGWRLSAQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKDFAAGRKSIALDLVTEIGRVPSHLAHRTRNALDNLVMLHTSEHGGKAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVASVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRSMPGTRRVMGITAEWLWRTLGRNKKPRLCTREEFTKKVRTNAAMGAVFTEENQWDSAKAAVEDEDFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPTGTVMDIISRKDQRGSGQVGTYGLNTFTNMEAQLIRQMEGEGVLSKADLENPHLPEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLRETACLGKAYAQMWSLMYFHRRDLRLASNAICSAVPVHWVPTSRTTWSIHAHHQWMTTEDMLTVWNRVWIEDNPWMEDKTPVTTWENVPYLGKREDQWCGSLIGLTSRATWAQNIPTAIQQVRSLIGNEEFLDYMPSMKRFRKEEESEGAIW

SEQ ID NO: 4912 - protein, 3290 aa, Artificial Sequence
  derived and/or modified protein sequence (wt) from DENV-3__FJ390375__SS-prME
TSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAVLPEEQDQNYVCKHTYVDRGWGNGCGLFGKGSLVTCAKFQCLEPIEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDVPCKIPFSTEDGQGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDTIGVLEQGKRTLTPQPMELKYSWKTWGKAKIVTAETQNSSFIIDGPNTPECPSASRAWNVWEVEDYGFGVFTTNIWLKLREVYTQLCDHRLMSAAVKDERAVHADMGYWIESQKNGSWKLEKASLIEVKTCTWPKSHTLWSNGVLESDMIIPKSLAGPISQHNYRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGKVDNFTMGVLCLAILFEEVMRGKFGKKHMIAGVFFTFVLLLSGQITWRDMAHTLIMIGSNASDRMGMGVTYLALIATFKIQPFLALGFFLRKLTSRENLLLGVGLAMATTLQLPEDIEQMANGIALGLMALKLTTQFETYQLWTALISLTCSNTIFTLTVAWRTATLILAGVSLLPVCQSSSMRKTDWLPMTVAAMGVPPLPLFIFSLKDTLKRRSWPLNEGVMAVGLVSILASSLLRNDVPMAGPLVAGGLLIACYVITGTSADLTVEKAADVTWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTYNGKRLEPNWASVKKDLISYGGGWRLSAQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKDFAAGRKSIALDLVTEIGRVPSHLAHRTRNALDNLVMLHTSEHGGKAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVASVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRSMPGTRRVMGITAEWLWRTLGRNKKPRLCTREEFTKKVRTNAAMGAVFTEENQWDSAKAAVEDEDFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPTGTVMDIISRKDQRGSGQVGTYGLNTFTNMEAQLIRQMEGEGVLSKADLENPHLPEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLRETACLGKAYAQMWSLMYFHRRDLRLASNAICSAVPVHWVPTSRTTWSIHAHHQWMTTEDMLTVWNRVWIEDNPWMEDKTPVTTWENVPYLGKREDQWCGSLIGLTSRATWAQNIPTAIQQVRSLIGNEEFLDYMPSMKRFRKEEESEGAIW

SEQ ID NO: 4913 - protein, 3290 aa, Artificial Sequence
  derived and/or modified protein sequence (wt) from DENV-3__FJ390376__SS-prME
TSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFTLLMLVTPSMTMRCVGVGNRDFVEGLSGATWVDVVLEHGGCVTTMAKNKPTLDIELQKTEATQLATLRKLCIEGKITNITTDSRCPTQGEAVLPEEQDQNYVCKHTYVDRGWGNGCGLFGKGSLVTCAKFQCLEPIEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDVPCKIPFSTEDGQGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSASRAWNVWEVEDYGFGVFTTNIWLKLREVYTQLCDHRLMSAAVKDERAVHADMGYWIESQKNGSWKLEKASLIEVKTCTWPKSHTLWSNGVLESDMIIPKSLAGPISQHNYRPGYHTQTAGPWHLGKLELDFNYCEGTTVVITENCGTRGPSLRTTTVSGKLIHEWCCRSCTLPPLRYMGEDGCWYGMEIRPISEREENMVKSLVSAGSGKVDNFTMGVLCLAILFEEVMRGKFGKKHMIAGVFFTFVLLLSGQIIWRDMAHTLIMIGSNASDRMGMGVTYLALIATFKIQPFLALGFFLRKLTSRENLLLGVGLAMATTLQLPEDIEQMANGIALGLMALKLITQFETYQLWTALISLTCSNTIFTLTVAWRTATLILAGVSLLPVCQSSSMRKTDWLPMTVAAMGVPPLPLFIFSLKDTLKRRSWPLNEGVMAVGLVSILASSLLRNDVPMAGPLVAGGLLIACYVITGTSADLTVEKAADVTWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTYNGKRLEPNWASVKKDLISYGGGWRLSAQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKDFAAGRKSIALDLVTEIGRVPSHLAHRTRNALDNLVMLHTSEHGGKAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVASVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRSMPGTRRVMGITAEWLWRTLGRNKKPRLCTREEFTKKVRTNAAMGAVFTEENQWDSAKAAVEDEDFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPTGTVMDIISRKDQRGSGQVGTYGLNTFTNMEAQLIRQMEGEGVLSKADLENPHLPEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLRETACLGKAYAQMWSLMYFHRRDLRLASNAICSAVPVHWVPTSRTTWSIHAHHQWMTTEDMLTVWNRVWIEDNPWMEDKTPVTTWENVPYLGKREDQWCGSLIGLTSRATWAQNIPTAIQQVRSLIGNEEFLDYMPSMKRFRKEEESEGAIW

SEQ ID NO: 4914 - protein, 3290 aa, Artificial Sequence
  derived and/or modified protein sequence (wt) from DENV-3__FJ390377__SS-prME
TSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFTLLMLVTPSMTMRCVGVGNRDFVEGLSGATWVDVVLEHGGCVTTMAKNKPTLDIELQKTEATQLATLRKLCIEGKITNITTDSRCPTQGEAVLPEEQDQNYVCKHTYVDRGWGNGCGLFGKGSLVTCAKFQCLEPIEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDVPCKIPFSTEDGQGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSASRAWNVWEVEDYGFGVFTTNIWLKLREVYTQLCDHRLMSAAVKDERAVHADMGYWIESQKNGSWKLEKASLIEVKTCTWPKSHTLWSNGVLESDMIIPKSLAGPISQHNYRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGKVDNFTMGVLCLAILFEEVMRGKFGKKHMIAGVFFTFVLLLSGQITWRDMAHTLIMIGSNASDRMGMGVTYLALIATFKIQPFLALGFFLRKLTSRENLLLGVGLAMATTLQLPEDIEQMANGIALGLMALKLITQFETYQLWTALISLTCSNTIFTLTVAWRTATLILAGVSLLPVCQSSSMRKTDWLPMTVAAMGVPPLPLFIFSLKDTLKRRSWPLNEGVMAVGLVSILASSLLRNDVPMAGPLVAGGLLIACYVITGTSADLTVEKAADVTWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTYNGKRLEPNWASVKKDLISYGGGWRLSAQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKDFAAGRKSIALDLVTEIGRVPSHLAHRTRNALDNLVMLHTSEHGGKAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVASVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRSMPGTRRVMGITAEWLWRTLGRNKKPRLCTREEFTKKVRTNAAMGAVFTEENQWDSAKAAVEDEDFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPTGTVMDIISRKDQRGSGQVGTYGLNTFTNMEAQLIRQMEGEGVLSKADLENPHLPEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLRETACLGKAYAQMWSLMYFHRRDLRLASNAICSAVPVHWVPTSRTTWSIHAHHQWMTTEDMLTVWNRVWIEDNPWMEDKTPVTTWENVPYLGKREDQWCGSLIGLTSRATWAQNIPTAIQQVRSLIGNEEFLDYMPSMKRFRKEEESEGAIW

SEQ ID NO: 4915 - protein, 3290 aa, Artificial Sequence
  derived and/or modified protein sequence (wt) from DENV-3__FJ547069__SS-prME
TSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAVLPEEQDQNYVCKHTYVDRGWGNGCGLFGKGSLVTCAKFQCLEPIEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNLGGTSIFAGHLKCRLKMDKLELKGMSYAMCTNTFVLKKEVSETQHGTILIKVEYKGEDVPCKIPFSTEDGQGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSASRAWNVWEVEDYGFGVFTTNIWLKLREVYTQLCDHRLMSAAVKDERAVHADMGYWIESQKNGSWKLEKASLIEVKTCTWPKSHTLWSNGVLESDMIIPKSLAGPISQHNYRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGKVDNFTMGVLCLAILFEEVMRGKFGKKHMIAGVFFTFVLLLSGQITWRDMAHTLIMIGSNASDRMGMGVTYLALIATFKIQPFLALGFFLRKLTSRENLLLGVGLAMATTLQLPEDIEQMANGIALGLMALKLITQFETYQLWTALISLTCSNTIFTLTVAWRTATLILAGVSLLPVCQSSSMRKTDWLPMTVAAMGVPPLPLFIFSLKDTLKRRSWPLNEGVMAVGLVSILASSLLRNDVPMAGPLVAGGLLIACYVITGTSADLTVEKAADVTWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTYNGKRLEPNWASVKKDLISYGGGWRLSAQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKDFAAGRKSIALDLVTEIGRVPSHLAHRTRNALDNLVMLHTSEHGGKAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVASVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRSMPGTRRVMGITAEWLWRTLGRNKKPRLCTREEFTKKVRTNAAMGAVFTEENQWDSAKAAVEDEDFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPTGTVMDIISRKDQRGSGQVGTYGLNTFTNMEAQLIRQMEGEGVLSKADLENPHLPEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLRETACLGKAYAQMWSLMYFHRRDLRLASNAICSAVPVHWVPTSRTTWSIHAHHQWMTTEDMLTVWNRVWIEDNPWMEDKTPVTTWENVPYLGKREDQWCGSLIGLTSRATWAQNIPTAIQQVRSLIGNEEFLDYMPSMKRFRKEEESEGAIW

SEQ ID NO: 4916 - protein, 3290 aa, Artificial Sequence
  derived and/or modified protein sequence (wt) from DENV-3__FJ562107__SS-prME
TSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAVLPEEQDQNYVCKHTYVDRGWGNGCGLFGKGSLVTCAKFQCLEPIEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDVPCKIPFSTEDGQGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIVIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSASRAWNVWEVEDYGFGVFTTNIWLKLREVYTQLCDHRLMSAAVKDERAVHADMGYWIESQKNGSWKLEKASLIEVKTCTWPKSHTLWSNGVLESDMIIPKSLAGPISQHNYRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGKVDNFTMGVLCLAILFEEVMRGKFGKKHMIAGVFFTFVLLLSGQITWRDMAHTLIMIGSNASDRMGMGVTYLALIATFKIQPFLALGFFLRKLTSRENLLLGVGLAMATTLQLPEDIEQMANGIALGLMALKLITQFETYQLWTALISLTCSNTIFTLTVAWRTATLILAGVSLLPVCQSSSMRKTDWLPMTVAAMGVPPLPLFIFSLKDTLKRRSWPLNEGVMAVGLVSILASSLLRNDVPMAGPLVAGGLLIACYVITGTSADLTVEKAADVTWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTYNGKRLEPNWASVKKDLISYGGGWRLSAQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAYKVASEGIKYTDRKWCFDGQRNNQILEENMDVEIWTKEGEKKKLRPRWLDARTYSDPLALKEFKDFAAGRKSIALDLVTEIGRVPSHLAHRTRNALDNLVMLHTSEHGGKAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVASVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRSMPGTRRVMGITAEWLWRTLGRNKKPRLCTREEFTKKVRTNAAMGAVFTEENQWDSAKAAVEDEDFWILVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPTGTVMDIISRKDQRGSGQVGTYGLNTFTNMEAQLIRQMEGEGVLSKADLENPHLPEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLRETACLGKAYAQMWSLMYFHRRDLRLASNAICSAVPVHWVPTSRTTWSIHAHHQWMTTEDMLTVWNRVWIEDNPWMEDKTPVTTWENVPYLGKREDQWCGSLIGLTSRATWAQNIPTAIQQVRSLIGNEEFLDYMPSMKRFRKEEESEGAIW

SEQ ID NO: 4917 - protein, 3290 aa, Artificial Sequence
  derived and/or modified protein sequence (wt) from DENV-3__FJ547071__SS-prME
TSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAVLPEEQDQNYVCKHTYVDRGWGNGCGLFGKGSLVTCAKFQCLEPIEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDVPCKIPFSTEDGQGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSASRAWNVWEVEDYGFGVFTTNIWLKLREVYTQLCDHRLMSAAVKDERAVHADMGYWIESQKNGSWKLEKASLIEVKTCTWPKSHTLWSNGVLESDMIIPKSLAGPISQHNYRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGKVDNFTMGVLCLAILFEEVMRGKFGKKHMIAGVFFTFVLLLSGQITWRDMAHTLIMIGSNASDRMGMGVTYLALIATFKIQPFLALGFFLRKLTSRENLLLGVGLAMATTLQLPEDIEQMANGIALGLMALKLITQFETYQLWTALISLTCSNTIFTLTVAWRTATLILAGVSLLPVCQSSSMRKTDWLPMTVAAMGVPPLPLFIFSLKDTLKRRSWPLNEGVMAVGLVSILASSLLRNDVPMAGPLVAGGLLIACYVITGTSADLTVEKTADVTWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTYNGKRLEPNWASVKKDLISYGGGWRLSAQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKDFAAGRKSIALDLVTEIGRVPSHLAHRTRNALDNLVMLHTSEHGGKAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLILCAVQLLLMRTSWALCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVASVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRSMPGTRRVMGITAEWLWRTLGRNKKPRLCTREEFTKKVRTNAAMGAVFTEENQWDSAKAAVEDEDFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPTGTVMDIISRKDQRGSGQVGTYGLNTFTNMEAQLIRQMEGEGVLSKADLENPHLPEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLRETACLGKAYAQMWSLMYFHRRDLRLASNAICSAVPVHWVPTSRTTWSIHAHHQWMTTEDMLTVWNRVWIEDNPWMEDKTPVTTWENVPYLGKREDQWCGSLIGLTSRATWAQNIPTAIQQVRSLIGNEEFLDYMPSMKRFRKEEESEGAIW

SEQ ID NO: 4918 - protein, 3290 aa, Artificial Sequence
  derived and/or modified protein sequence (wt) from DENV-3__FJ410176__SS-prME
TSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAVLPEEQDQNYVCKHTYVDRGWGNGCGLFGKGSLVTCAKFQCLEPIEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDVPCKIPFSTEDGQGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDTIGVLEQGKRTLTPQPMELKYSWKTWGKAKIVTAETQNSSFIIDGPNTPECPSASRAWNVWEVEDYGFGVFTTNIWLKLREVYTQLCDHRLMSAAVKDERAVHADMGYWIESQKNGSWKLEKASLIEVKTCTWPKSHTLWSNGVLESDMIIPKSLAGPISQHNYRPGYHTQTAGPWHLGKLELDFNYCEGTTVVITENCGTRGSSLRTTTVSGKLIHEWCCRSCTLPPLRYMGEDGCWYGMEIRPISEKEENMVKSLVSAGSGKVDNFTMGVLCLAILFEEVMRGKFGKKHMIAGVLFTFVLLLSGQITWRDMAHTLIMIGSNASDRMGMGVTYLALIATFKIQPFLALGFFLRKLTSRENLLLGVGLAMATTLQLPEDIEQMANGIALGLMALKLTTQFETYQLWTALISLTCSNTIFTLTVAWRTATLILAGVSLLPVCQSSSMRKTDWLPMTVAAMGVPPLPLFIFSLKDTLKRRSWPLNEGVMAVGLVSILASSLLRNDVPMAGPLVAGGLLIACYVITGTSADLTVEKAADVTWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTYNGKRLEPNWASVKKDLISYGGGWRLSAQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKDFAAGRKSIALDLVTEIGRVPSHLAHRTRNALDNLVMLHTSEHGGKAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVASVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRSMPGTRRVMGITAEWLWRTLGRNKKPRLCTREEFTKKVRTNAAMGAVFTEENQWDSAKAAVEDEDFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPTGTVMDIISRKDQRGSGQVGTYGLNTFTNMEAQLIRQMEGEGVLSKADLENPHLPEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLRETACLGKAYAQMWSLMYFHRRDLRLASNAICSAVPVHWVPTSRTTWSIHAHHQWMTTEDMLTVWNRVWIEDNPWMEDKTPVTTWENVPYLGKREDQWCGSLIGLTSRATWAQNIPTAIQQVRSLIGNEEFLDYMPSMKRFRKEEESEGAIW

SEQ ID NO: 4919 - protein, 3290 aa, Artificial Sequence
  derived and/or modified protein sequence (wt) from DENV-3__FJ410177__SS-prME
TSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAVLPEEQDQNYVCKHTYVDRGWGNGCGLFGKGSLVTCAKFQCLEPIEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDVPCKIPFSTEDGQGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDTIGVLEQGKRTLTPQPMELKYSWKTWGKAKIVTAETQNSSFIIDGPNTPECPSASRAWNVWEVEDYGFGVFTTNIWLKLREVYTQLCDHRLMSAAVKDERAVHADMGYWIESQKNGSWKLEKASLIEVKTCTWPKSHTLWSNGVLESDMIIPKSLAGPISQHNYRPGYHTQTAGPWHLGKLELDFNYCEGTTVVITENCGTGGPSLRTTTVSGKLIHEWCCRSCTLPPLRYMGEDGCWYGMEIRPISEKEENMVKSLVSAGSGKVDNFTMGVLCLAILFEEVMRGKFGKKHMIAGVFFTFVLLLSGQITWRDMAHTLIMIGSNASDRMGMGVTYLALIATFKIQPFLALGFFLRKLTSRENLLLGVGLAMATTLQLPEDIEQMANGIALGLMALKLTTQFETYQLWTALISLTCSNTIFTLTVAWRTATLILAGVSLLPVCQSSSMRKTDWLPMTVAAMGVPPLPLFIFSLKDTLKRRSWPLNEGVMAVGLVSILASSLLRNDVPMAGPLVAGGLLIACYVITGTSADLTVEKAADVTWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTYNGKRLEPNWASVKKDLISYGGGWRLSAQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKDFAAGRKSIALDLVTEIGRVPSHLAHRTRNALDNLVMLHTSEHGGKAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVASVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRSMPGTRRVMGITAEWLWRTLGRNKKPRLCTREEFTKKVRTNAAMGAVFTEENQWDSAKAAVEDEDFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPTGTVMDIISRKDQRGSGQVGTYGLNTFTNMEAQLIRQMEGEGVLSKADLENPHLPEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLRETACLGKAYAQMWSLMYFHRRDLRLASNAICSAVPVHWVPTSRTTWSIHAHHQWMTTEDMLTVWNRVWIEDNPWMEDKTPVTTWENVPYLGKREDQWCGSLIGLTSRATWAQNIPTAIQQVRSLIGNEEFLDYMPSMKRFRKEEESEGAIW

SEQ ID NO: 4920 - protein, 3290 aa, Artificial Sequence
  derived and/or modified protein sequence (wt) from DENV-3__FJ547072__SS-prME
TSLCLMMILPAALAFHLTSRDGEPRMIVGKNERGRSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAVLPEEQDQNYVCKHTYVDRGWGNGCGLFGKGSLVTCAKFQCLEPIEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDVPCKIPFSTEDGQGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIVIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSASRAWNVWEVEDYGFGVFTTNIWLKLREVYTQLCDHRLMSAAVKDERAVHADMGYWIESQKNGSWKLEKASLIEVKTCTWPKSHTLWSNGVLESDMIIPKSLAGPISQHNYRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGKVDNFTMGVLCLAILFEEVMRGKFGKKHMIAGVFFTFVLLLSGQITWRDMAHTLIMIGSNASDRMGMGVTYLALIATFKIQPFLALGFFLRKLTSRENLLLGVGLAMATTLQLPEDIEQMANGIALGLMALKLITQFETYQLWTALISLTCSNTIFTLTVAWRTATLILAGVSLLPVCQSSSMRKTDWLPMTVAAMGVPPLPLFIFSLKDTLKRRSWPLNEGVMAVGLVSILASSLLRNDVPMAGPLVAGGLLIACYVITGTSADLTVEKAADVTWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTYNGKRLEPNWASVKKDLISYGGGWRLSAQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKDFAAGRKSIALDLVTEIGRVPSHLAHRTRNALDNLVMLHTSEHGGKAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVASVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRSMPGTRRVMGITAEWLWRTLGRNKKPRLCTREEFTKKVRTNAAMGAVFTEENQWDSAKAAVEDEDFWILVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPTGTVMDIISRKDQRGSGQVGTYGLNTFTNMEAQLIRQMEGEGVLSKADLENPHLPEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLRETACLGKAYAQMWSLMYFHRRDLRLASNAICSAVPVHWVPTSRTTWSIHAHHQWMTTEDMLTVWNRVWIEDNPWMEDKTPVTTWENVPYLGKREDQWCGSLIGLTSRATWAQNIPTAIQQVRSLIGNEEFLDYMPSMKRFRKEEESEGAIW

SEQ ID NO: 4921 - protein, 3290 aa, Artificial Sequence
  derived and/or modified protein sequence (wt) from DENV-3__FJ547073__SS-prME
TSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAVLPEEQDQNYVCKHTYVDRGWGNGCGLFGKGSLVTCAKFQCLEPIEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDVPCKIPFSTEDGQGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIVIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSASRAWNVWEVEDYGFGVFTTNIWLKLREVYTQLCDHRLMSAAVKDERAVHADMGYWIESQKNGSWKLEKASLIEVKTCTWPKSHTLWSNGVLESDMIIPKSLAGPISQHNYRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGKVDNFTMGVLCLAILFEEVMRGKFGKKHMIAGVFFTFVLLLSGQITWRDMAHTLIMIGSNASDRMGMGVTYLALIATFKIQPFLALGFFLRKLTSRENLLLGVGLAMATTLQLPEDIEQMANGIALGLMALKLITQFETYQLWTALISLTCSNTIFTLTVAWRTATLILAGVSLLPVCQSSSMRKTDWLPMTVAAMGVPPLPLFIFSLKDTLKRRSWPLNEGVMAVGLVSILASSLLRNDVPMAGPLVAGGLLIACYVITGTSADLTVEKAADVTWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTYNGKRLEPNWASVKKDLISYGGGWRLSAQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKDFAAGRKSIALDLVTEIGRVPSHLAHRTRNALDNLVMLHTSEHGGKAYRYAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVASVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRSMPGTRRVMGITAEWLWRTLGRNKKPRLCTREEFTKKVRTNAAMGAVFTEENQWDSAKAAVEDEDFWILVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPTGTVMDIISRKDQRGSGQVGTYGLNTFTNMEAQLIRQMEGEGVLSKADLENPHLPEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLRETACLGKAYAQMWSLMYFHRRDLRLASNAICSAVPVHWVPTSRTTWSIHAHHQWMTTEDMLTVWNRVWIEDNPWMEDKTPVTTWENVPYLGKREDQWCGSLIGLTSRATWAQNIPTAIQQVRSLIGNEEFLDYMPSMKRFRKEEESEGAIW

SEQ ID NO: 4922 - protein, 3290 aa, Artificial Sequence
  derived and/or modified protein sequence (wt) from DENV-3__FJ547074__SS-prME
TSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAVLPEEQDQNYVCKHTYVDRGWGNGCGLFGKGSLVTCAKFQCLEPIEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDVPCKIPFSTEDGQGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIVIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSASRAWNVWEVEDYGFGVFTTNIWLKLREVYTQLCDHRLMSAAVKDERAVHADMGYWIESQKNGSWKLEKASLIEVKTCTWPKSHTLWSNGVLESDMIIPKSLAGPISQHNYRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGKVDNFTMGVLCLAILFEEVMRGKFGKKHMIAGVFFTFVLLLSGQITWRDMAHTLIMIGSNASDRMGMGVTYLALIATFKIQPFLALGFFLRKLTSRENLLLGVGLAMATTLQLPEDIEQMANGIALGLMALKLITQFETYQLWTALISLTCSNTIFTLTVAWRTATLILAGVSLLPVCQSSSMRKTDWLPMTVAAMGVPPLPLFIFSLKDTLKRRSWPLNEGVMAVGLVSILASSLLRNDVPMAGPLVAGGLLIACYVITGTSADLTVEKAADVTWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTYNGKRLEPNWASVKKDLISYGGGWRLSAQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKDFAAGRKSIALDLVTEIGRVPSHLAHRTRNALDNLVMLHTSEHGGKAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVASVNMVSRLLLNRFTMTYRRPTIEKDVVLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRSMPGTRRVMGITAEWLWRTLGRNKKPRLCTREEFTKKVRTNAAMGAVFTEENQWDSAKAAVEDEDFWILVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPTGTVMDIISRKDQRGSGQVGTYGLNTFTNMEAQLIRQMEGEGVLSKADLENPHLPEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLRETACLGKAYAQMWSLMYFHRRDLRLASNAICSAVPVHWVPTSRTTWSIHAHHQWMTTEDMLTVWNRVWIEDNPWMEDKTPVTTWENVPYLGKREDQWCGSLIGLTSRATWAQNIPTAIQQVRSLIGNEEFLDYMPSMKRFRKEEESEGAIW

SEQ ID NO: 4923 - protein, 3290 aa, Artificial Sequence
  derived and/or modified protein sequence (wt) from DENV-3__FJ547075__SS-prME
TSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAVLPEEQDQNYVCKHTYVDRGWGNGCGLFGKGSLVTCAKFQCLEPIEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDVPCKIPFSTEDGQGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIVIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSASRAWNVWEVEDYGFGVFTTNIWLKLREVYTQLCDHRLMSAAVKDERAVHADMGYWIESQKNGSWKLEKASLIEVKTCTWPKSHTLWSNGVLESDMIIPKSLAGPISQHNYRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGKVDNFTMGVLCLAILFEEVMRGKFGKKHMIAGVFFTFVLLLSGQITWRDMAHTLIMIGSNASDRMGMGVTYLALIATFKIQPFLALGFFLRKLTSRENLLLGVGLAMATTLQLPEDIEQMANGIALGLMALKLITQFETYQLWTALISLTCSNTIFTLTVAWRTATLILAGVSLLPVCQSSSMRKTDWLPMTVAAMGVPPLPLFIFSLKDTLKRRSWPLNEGVMAVGLVSILASSLLRNDVPMAGPLVAGGLLIACYVITGTSADLTVEKAADVTWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTYNGKRLEPNWASVKKDLISYGGGWRLSAQWQKGEEVQVIAVEPGKNPKNFQTMPGTFQTTTGEIGAIALDFKPGTSGSPIINREGKVVGLYGNGVVTKNGGYVSGIAQTNAESDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKDFAAGRKSIALDLVTEIGRVPSHLAHRTRNALDNLVMLHTSEHGGKAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVASVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRSMPGTRRVMGITAEWLWRTLGRNKKPRLCTREEFTKKVRTNAAMGAVFTEENQWDSAKAAVEDEDFWILVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPTGTVMDIISRKDQRGSGQVGTYGLNTFTNMEAQLIRQMEGEGVLSKADLENPHLPEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLRETACLGKAYAQMWSLMYFHRRDLRLASNAICSAVPVHWVPTSRTTWSIHAHHQWMTTEDMLTVWNRVWIEDNPWMEDKTPVTTWENVPYLGKREDQWCGSLIGLTSRATWAQNIPTAIQQVRSLIGNEEFLDYMPSMKRFRKEEESEGAIW

SEQ ID NO: 4924 - protein, 3290 aa, Artificial Sequence
  derived and/or modified protein sequence (wt) from DENV-3__FJ547076__SS-prME
TSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAVLPEEQDQNYVCKHTYVDRGWGNGCGLFGKGSLVTCAKFQCLEPIEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDVPCKIPFSTEDGQGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSASRAWNVWEVEDYGFGVFTTNIWLKLREVYTQLCDHRLMSAAVKDERAVHADMGYWIESQKNGSWKLEKASLIEVKTCTWPKSHTLWSNGVLESDMIIPKSLAGPISQHNYRPGYHTQTAGPWHLGKLELDFNYCEGTTVVITENCGTRGPSLRTTTVSGKLIHEWCCRSCTLPPLRYMGEDGCWYGMEIRPVSEKEENMVKSLVSAGSGKVDNFTMGVLCLAILFEEVMRGKFGKKHMIAGVFFTFVLLLSGQITWRDMAHTLIMIGSNASDRMGMGVTYLALIATFKIQPFLALGFFLRKLTSRENLLLGVGLAMATTLQLPEDIEQMANGIALGLMALKLITQFETYQLWTALISLTCSNTIFTLTVAWRTATLILAGVSLLPVCQSSSMRKTDWLPMTVAAMGVPPLPLFIFSLKDTLKRRSWPLNEGVMAVGLVSILASSLLRNDVPMAGPLVAGGLLIACYVITGTSADLTVEKAADVTWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTYNGKRLEPNWASVKKDLISYGGGWRLSAQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKDFAAGRKSIALDLVTEIGRVPSHLAHRTRNALDNLVMLHTSEHGGKAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVASVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRSMPGTRRVMGITAEWLWRTLGRNKKPRLCTREEFTKKVRTNAAMGAVFTEENQWDSAKAAVEDEDFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPTGTVMDIISRKDQRGSGQVGTYGLNTFTNMEAQLIRQMEGEGVLSKADLENPHLPEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLRETACLGKAYAQMWSLMYFHRRDLRLASNAICSAVPVHWVPTSRTTWSIHAHHQWMTTEDMLTVWNRVWIEDNPWMEDKTPVTTWENVPYLGKREDQWCGSLIGLTSRATWAQNIPTAIQQVRSLIGNEEFLDYMPSMKRFRKEEESEGAIW

SEQ ID NO: 4925 - protein, 3290 aa, Artificial Sequence
  derived and/or modified protein sequence (wt) from DENV-3__FJ547077__SS-prME
TSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAVLPEEQDQNYVCKHTYVDRGWGNGCGLFGKGSLVTCAKFQCLEPIEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDAPCKIPFSTEDGQGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSASRAWNVWEVEDYGFGVFTTNIWLKLREVYTQLCDHRLMSAAVKDERAVHADMGYWIESQKNGSWKLEKASLIEVKTCTWPKSHTLWSNGVLESDMIIPKSLAGPISQHNYRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGKVDNFTMGVLCLAILFEEVMRGKFGKKHMIAGVFFTFVLLLSGQITWRDMAHTLIMIGSNASDRMGMGVTYLALIATFKIQPFLALGFFLRKLTSRENLLLGVGLAMATTLQLPEDIEQMANGIALGLMALKLITQFETYQLWTALISLTCSNTIFTLTVAWRTATLILAGVSLLPVCQSSSMRKTDWLPMTVAAMGVPPLPLFIFSLKDTLKRRSWPLNEGVMAVGLVSILASSLLRNDVPMAGPLVAGGLLIACYVITGTSADLTVEKAADVTWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTYNGKRLEPNWASVKKDLISYGGGWRLSAQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKDFAAGRKSIALDLVTEIGRVPSHLAHRTRNALDNLVMLHTSEHGGKAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAATIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVASVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRSMPGTRRVMGITAEWLWRTLGRNKKPRLCTREEFTKKVRTNAAMGAVFTEENQWDSAKAAVEDEDFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPTGTVMDIISRKDQRGSGQVGTYGLNTFTNMEAQLIRQMEGEGVLSKADLENPHLPEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLRETACLGKAYAQMWNLMYFHRRDLRLASNAICSAVPVHWVPTSRTTWSIHAHHQWMTTEDMLTVWNRVWIEDNPWMEDKTPVTTWENVPYLGKREDQWCGSLIGLTSRATWAQNIPTAIQQVRSLIGNEEFLDYMPSMKRFRKEEESEGAIW

SEQ ID NO: 4926 - protein, 3290 aa, Artificial Sequence
  derived and/or modified protein sequence (wt) from DENV-3__FJ547078__SS-prME
TSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWIDVVLEHGGCVTTMAKNKPTLDIELQKTEATQLATLRKLCIEGKITNITTDSRCPTQGEAVLPEEQDQNYVCKHTYVDRGWGNGCGLFGKGSLVTCAKFQCLEPIEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDVPCKIPFSTEDGQGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSASRAWNVWEVEDYGFGVFTTNIWLKLREVYTQLCDHRLMSAAVKDERAVHADMGYWIESQKNGSWKLEKASLIEVKTCTWPKSHTLWSNGVLESDMIIPKSLAGPISQHNYRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGKVDNFTMGVLCLAILFEEVMRGKFGKKHMIAGVFFTFVLLLSGQITWRDMAHTLIMIGSNASDRMGMGVTYLALIATFKIQPFLALGFFLRKLTSRENLLLGVGLAMATTLQLPEDIEQMANGIALGLMALKLITQFEIYQLWTALISLTCSNTIFTLTVAWRTATLILAGVSLLPVCQSSSMRKTDWLPMTVAAMGVPPLPLFIFSLKDTLKRRSWPLNEGVMAVGLVSILASSLLRNDVPMAGPLVAGGLLIACYVITGTSADLTVEKAADVTWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTYNGKRLEPNWASVKKDLISYGGGWRLSAQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKDFAAGRKSIALDLVTEIGRVPSHLAHRTRNALDNLVMLHTSEHGGKAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVASVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPKSMPGTRRVMGITAEWLWRTLGRNKKPRLCTREEFTKKVRTNAAMGAVFTEENQWDSAKAAVEDEDFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPTGTVMDIISRKDQRGSGQVGTYGLNTFTNMEAQLIRQMEGEGVLSKADLENPHLPEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLRETACLGKAYAQMWSLMYFHRRDLRLASNAICSAVPVHWVPTSRTTWSIHAHHQWMTTEDMLTVWNRVWIEDNPWMEDKTPVTTWENVPYLGKREDQWCGSLIGLTSRATWAQNIPTAIQQVRSLIGNEEFLDYMPSMKRFRKEEESEGAIW

SEQ ID NO: 4927 - protein, 3290 aa, Artificial Sequence
  derived and/or modified protein sequence (wt) from DENV-3__FJ547079__SS-prME
TSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAVLPEEQDQNYVCKHTYVDRGWGNGCGLFGKGSLVTCAKFQCLEPIEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDVPCKIPFSTEDGQGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSASRAWNVWEVEDYGFGVFTTNIWLKLREVYTQLCDHRLMSAAVKDERAVHADMGYWIESQKNGSWKLEKASLIEVKTCTWPKSHTLWSNGVLESDMIIPKSLAGPISQHNYRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGKVDNFTMGVLCLAILFEEVMRGKFGKKHMIAGVFFTFVLLLSGQITWRDMAHTLIMIGSNASDRMGMGVTYLALIATFKIQPFLALGFFLRKLTSRENLLLGVGLAMATTLQLPEDIEQMANGIALGLMALKLITQFETYQLWTALISLTCSNTIFTLTVAWRTATLILAGVSLLPVCQSSSMRKTDWLPMTVAAMGVPPLPLFIFSLKDTLKRRSWPLNEGVMAVGLVSILASSLLRNDVPMAGPLVAGGLLIACYVITGTSADLTVEKAADVTWEEEAEQTGVSHNLMITVDDDGTMRIKDDETENILTVLLKTALLIVSGIFPYSIPATLLVWHTWHKQTQRSGVLWDVPSPPETQKAELEEGVYRIKQQGIFGKTQVGVGVQKEGVFHTMWHVTRGAVLTYNGKRLEPNWASVKKDLISYGGGWRLSAQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKDFAAGRKSIALDLVTEIGRVPSHLAHRTRNALDNLVMLHTSEHGGKAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVASVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRSMPGTRRVMGITAEWLWRTLGRNKKPRLCTREEFTKKVRTNAAMGAVFTEENQWDSAKAAVEDEDFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPTGTVMDIISRKDQRGSGQVGTYGLNTFTNMEAQLIRQMEGEGVLSKADLENPHLPEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLRETACLGKAYAQMWSLMYFHRRDLRLASNAICSAVPVHWVPTSRTTWSIHAHHQWMTTEDMLTVWNRVWIEDNPWMEDKTPVTTWENVPYLGKREDQWCGSLIGLTSRATWAQNIPTAIQQVRSLIGNEEFLDYMPSMKRFRKEEESEGAIW

SEQ ID NO: 4928 - protein, 3290 aa, Artificial Sequence
  derived and/or modified protein sequence (wt) from DENV-3__FJ547080__SS-prME
TSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAVLPEEQDQNYVCKHTYVDRGWGNGCGLFGKGSLVTCAKFQCLEPIEGKVVQHENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDVPCKIPFSTEDGQGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIVIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSASRAWNVWEVEDYGFGVFTTNIWLKLREVYTQLCDHRLMSAAVKDERAVHADMGYWIESQKNGSWKLEKASLIEVKTCTWPKSHTLWSNGVLESDMIIPKSLAGPISQHNYRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGKVDNFTMGVLCLAILFEEVMRGKFGKKHMIAGVFFTFVLLLSGQITWRDMAHTLIMIGSNASDRMGMGVTYLALIATFKIQPFLALGFFLRKLTSRENLLLGVGLAMATTLQLPEDIEQMANGIALGLMALKLITQFETYQLWTALISLTCSNTIFTLTVAWRTATLILAGVSLLPVCQSSSMRKTDWLPMTVAAMGVPPLPLFIFSLKDTLKRRSWPLNEGVMAVGLVSILASSLLRNDVPMAGPLVAGGLLIACYVITGTSADLTVEKAADVTWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTYNGKRLEPNWASVKKDLISYGGGWRLSAQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPRKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKDFAAGRKSIALDLVTEIGRVPSHLAHRTRNALDNLVMLHTSEHGGKAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVASVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRSMPGTRRVMGITAEWLWRTLGRNKKPRLCTREEFTKKVRTNAAMGAVFTEENQWDSAKAAVEDEDFWILVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPTGTVMDIISRKDQRGSGQVGTYGLNTFTNMEAQLIRQMEGEGVLSKADLENPHLPEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLRETACLGKAYAQMWSLMYFHRRDLRLASNAICSAVPVHWVPTSRTTWSIHAHHQWMTTEDMLTVWNRVWIEDNPWMEDKTPVTTWENVPYLGKREDQWCGSLIGLTSRATWAQNIPTAIQQVRSLIGNEEFLDYMPSMKRFRKEEESEGAIW

SEQ ID NO: 4929 - protein, 3290 aa, Artificial Sequence
  derived and/or modified protein sequence (wt) from DENV-3__FJ547081__SS-prME
TSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAVLPEEQDQNYVCKHTYVDRGWGNGCGLFGKGSLVTCAKFQCLEPIEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFSGHLKCRLKMDKLELKGMSYAMCTNTFVLKKEVSETQHGTILIKVEYKGEDVPCKIPFSTEDGQGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSASRAWNVWEVEDYGFGVFTTNIWLKLREVYTQLCDHRLMSAAVKDERAVHADMGYWIESQKNGSWKLEKASLIEVKTCTWPKSHTLWSNGVLESDMIIPKSLAGPISQHNYRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGKVDNFTMGVLCLAILFEEVMRGKFGKKHMIAGVFFTFVLLLSGQITWRDMAHTLIMIGSNASDRMGMGVTYLALIATFKIQPFLALGFFLRKLTSRENLLLGVGLAMATTLQLPEDIEQMANGIALGLMTLKLITQFETYQLWTALISLTCSNTIFTLTVAWRTATLILAGVSLLPVCQSSSMRKTDWLPMTVAAMGVPPLPLFIFSLKDTLKRRSWPLNEGVMAVGLVSILASSLLRNDVPMAGPLVAGGLLIACYVITGTSADLTVEKAADVTWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTYNGKRLEPNWASVKKDLISYGGGWRLSAQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYADRKWCFDGQRNNQILEENMDVEIWTKEGEKKKLRPRWLDARTYSDPLALKEFKDFAAGRKSIALDLVTEIGRVPSHLAHRTRNALDNLVMLHTSEHGGKAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAAIIAANEMGLLETTKRDLGMSKEPGVVSSTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVASVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRSMPGTRRVMGITAEWLWRTLGRNKKPRLCTREEFTKKVRTNAAMGAVFTEENQWDSAKAAVEDEDFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPTGTVMDIISRKDQRGSGQVGTYSLNTFTNMEAQLIRQMEGEGVLSKADLENPHLPEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLRETACLGKAYAQMWSLMYFHRRDLRLASNAICSAVPVHWVPTSRTTWSIHAHHQWMTTEDMLTVWNRVWIEDNPWMEDKTPVTTWENVPYLGKREDQWCGSLIGLTSRATWAQNIPTAIQQVRSLIGNEEFLDYMPSMKRFRKEEESEGAIW

SEQ ID NO: 4930 - protein, 3290 aa, Artificial Sequence
  derived and/or modified protein sequence (wt) from DENV-3__FJ547082__SS-prME
TSLCLMMILPAALAFHLTSRDGEPRMIVGKNERGKSLLFKTASGINMCTLIAMDLGEMCDDTVTYKCPHIAEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAVLPEEQDQNYVCKHTYVDRGWGNGCGLFGKGSLVTCAKFQCLEPIEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDVPCKIPFSTEDGQGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQADTGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKMWGKAKIVTAETQNSSFIIDGPNTPECPSASRAWNVWEVEDYGFGVFTTNIWLKLREVYTQLCDHRLMSAAVKDERAVHADMGYWIESQKNGSWKLEKASLIEVKTCTWPKSHTLWSNGVLESDMIIPKSLAGPISQHNYRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGKVDNFTMGVLCLAILFEEVMRGKFGKKHMIAGVFFTFVLLLSGQITWRDMAHTLIMIGSNASDRMGMGVTYLALIATFKIQPFLALGFFLRKLTSRENLLLGVGLAMATTLQLPEDIEQMANGIALGLMALKLITQFETYQLWTALISLTCSNTIFTLTVAWRTATLILAGVSLLPVCQSSSMRKSDWLPMTVAAMGVPPLPLFIFSLKDTLKRRSWPLNEGVMAVGLVSILASSLLRNDVPMAGPLVAGGLLIACYVITGTSADLTVEKAADVTWEEEAEQTGVSHNLMITVDDDGTMRIKDDETENILTVLLKTALLIVSGIFPYSIPATLLVWHTWQKQTRRSGVLWDVPSPPETQKAELEEGVYRIKQQGIFGKTQVGVGVQKEGVFHTMWHVTRGAVLTYNGKRLEPNWASVKKDLISYGGGWRLSAQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKDFAAGRKSIALDLVTEIGRVPSHLAHRTRNALDNLVMLHTSEHGGKAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVASVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRSMPGTRRVMGITAEWLWRTLGRNKKPRLCTREEFTKKVRTNAAMGAVFTEENQWDSAKAAVEDEDFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPTGTVMDIISRKDQRGSGQVGTYGLNTFTNMEAQLIRQMEGEGVLSKADLENPHLSEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLRETACLGKAYAQMWSLMYFHRRDLRLASNAICSAVPVHWVPTSRTTWSIHAHHQWMTTEDMLTVWNRVWIEDNPWMEDKTPVTTWENVPYLGKREDQWCGSLIGLTSRATWAQNIPTAIQQVRSLIGNEEFLDYMPSMKRFRKEEESEGAIW

SEQ ID NO: 4931 - protein, 3290 aa, Artificial Sequence
  derived and/or modified protein sequence (wt) from DENV-3__FJ547083__SS-prME
TSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGERRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAVLPEEQDQSYVCKHTYVDRGWGNGCGLFGKGSLVTCAKFQCLEPIEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDAPCKIPFSTEDGQGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDTIGVLEQGKRTLTPQPMELKYSWKTWGKAKIVTAETQNSSFIIDGPNTPECPSASRAWNVWEVEDYGFGVFTTNIWLKLREVYTQLCDHRLMSAAVKDERAVHADMGYWIESQKNGSWKLEKASLIEVKTCTWPKSHTLWSNGVLESDMIIPKSLAGPISQHNHRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGKVDNFTMGVLCLAILFEEVMRGKFGKKHMIAGVFFTFVLLLSGQITWRDMAHTLIMIGSSASDRMGMGVTYLALIATFKIQPFLALGFFLRKLTSRENLLLGVGLAMATTLQLPEDIEQMANGIALGLMALKLITQFETYQLWTALISLTCSNTMFTLTVAWRTATLILAGVSLLPVCQSSSMRKTDWLPMAVAAMGVPPLPLFIFSLKDTLKRRSWPLNEGVMAVGLVSILASSLLRNDVPMAGPLVAGGLLIACYVITGTSADLTVEKAADITWEEEAEQTGVSHNLMITVDDDGTMRIKDDETENILTVLLKTALLIVSGVFPYSIPATLLVWHTWQKQTQRSGVLWDVPSPPETQKAELEEGVYRIKQQGIFGKTQVGVGVQKEGVFHTMWHVTRGAVLTYNGKRLEPNWASVKKDLISYGGGWRLSAQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKDFAAGRKSIALDLVTEIGRVPSHLAHRTRNALDNLVMLHTSEHGGRAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVASVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRSMPGTRRVMGITAEWLWRTLGRNKKPRLCTREEFTKKVRTNAAMGAVFTEENQWDSAKAAVEDEDFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPTGTVMDIISRKDQRGSGQVGTYGLNTFTNMEAQLIRQMEGEGVLSKADLENPHLPEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLRETACLGKAYAQMWSLMYFHRRDLRLASNAICSAVPVHWVPTSRTTWSIHAHHQWMTTEDMLTVWNRVWIEDNPWMEDKTPVTTWENVPYLGKREDQWCGSLIGLTSRATWAQNIPTAIQQVRSLIGNEEFLDYMPSMKRFRKEEESEGAIW

SEQ ID NO: 4932 - protein, 3290 aa, Artificial Sequence
  derived and/or modified protein sequence (wt) from DENV-3__FJ547084__SS-prME
TSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAVLPEEQDQNYVCKHTYVDRGWGNGCGLFGKGSLVTCAKFQCLEPIEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDVPCKIPFSTEDGQGKAHNGRLITANPVVTKKEEPVNIEAEPPFGESNIVIGIGDNALKINWYKRGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDTIGVLEQGKRTLTPQPMELKYSWKTWGKAKIVTAETQNSSFIIDGPNTPECPSASRAWNVWEVEDYGFGVFTTNIWLKLREVYTQLCDHRLMSAAVKDERAVHADMGYWIESQKNGSWKLEKASLIEVKTCTWPKSHTLWSNGVLESDMIIPKSLAGPISQHNYRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGKVDNFTMGVLCLAILFEEVMRGKFGKKHMIVGVFFTFVLLLSGQITWRDMAHTLIMIGSNASDRMGMGVTYLALIATFKIQPFLALGFFLRKLTSRENLLLGVGLAMATTLQLPEDIEQMANGIALGLMALKLTTQFETYQLWTALISLTCSNTIFTLTVAWRTATLILAGVSLLPVCQSSSMRKTDWLPMTVAAMGVPPLPLFIFSLKDTLKRRSWPLNEGVMAVGLVSILASSLLRNDVPMAGPLVAGGLLIACYVITGTSADLTVEKAADVTWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTYNGKRLEPNWASVKKDLISYGGGWRLSAQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKDFAAGRKSIALDLVTEIGRVPSHLAHRTRNALDNLVMLHTSEHGGKAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVASVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRSMPGTRRVMGITAEWLWRTLGRNKKPRLCTREEFTKKVRTNAAMGAVFTEENQWDSAKAAVEDEDFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPTGTVMDIISRKDQRGSGQVGTYGLNTFTNMEAQLIRQMEGEGVLSKADLENPHLPEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLRETACLGKAYAQMWSLMYFHRRDLRLASNAICSAVPVHWVPTSRTTWSIHAHHQWMTTEDMLTVWNRVWIEDNPWMEDKTPVTTWENVPYLGKREDQWCGSLIGLTSRATWAQNIPTAIQQVRSLIGNEEFLDYMPSMKRFRKEEESEGAIW

SEQ ID NO: 4933 - protein, 3290 aa, Artificial Sequence
  derived and/or modified protein sequence (wt) from DENV-3__FJ478456__SS-prME
TSLCLMMILPAALAFHLTSRDGEPRMIVGKNERGKSLLFKTASGINMCTLIAMDLGEMCDDTVTYKCPHIAEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAVLPEEQDQNYVCKHTYVDRGWGNGCGLFGKGSLVTCAKFQCLEPIEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDVPCKIPFSTEDGQGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQADTGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSASRAWNVWEVEDYGFGVFTTNIWLKLREVYTQLCDHRLMSAAVKDERAVHADMGYWIESQKNGSWKLEKASLIEVKTCTWPKSHTLWSNGVLESDMIIPKSLAGPISQHNYRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGKVDNFTMGVLCLAILFEEVMRGKFGKKHMIAGVFFTFVLLLSGQITWRDMAHTLIMIGSNASDRMGMGVTYLALIATFKIQPFLALGFFLRKLTSRENLLLGVGLAMATTLQLPEDIEQMANGIALGLMALKLITQFETYQLWTALISLTCSNTIFTLTVAWRTATLILAGVSILPVCQSSSMRKSDWLPMTVAAMGVPPLPLFIFSLKDTLKRRSWPLNEGVMAVGLVSILASSLLRNDVPMAGPLVAGGLLIACYVITGTSADLTVEKAADVTWEEEAEQTGVSHNLMITVDDDGTMRIKDDETENILTVLLKTALLIVSGIFPYSIPATLLVWHTWQKQTRRSGVLWDVPSPPETQKAELEEGVYRIKQQGIFGKTQVGVGVQKEGVFHTMWHVTRGAVLTYNGKRLEPNWASVKKDLISYGGGWRLSAQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKDFAAGRKSIALDLVTEIGRVPSHLAHRTRNALDNLVMLHTSEHGGKAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVASVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRSMPGTRRVMGITAEWLWRTLGRNKKPRLCTREEFTKKVRTNAAMGAVFTEENQWDSAKAAVEDEDFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPTGTVMDIISRKDQRGSGQVGTYGLNTFTNMEAQLIRQMEGEGVLSKADLENPHLSEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLRETACLGKAYAQMWSLMYFHRRDLRLASNAICSAVPVHWVPTSRTTWSIHAHHQWMTTEDMLTVWNRVWIEDNPWMEDKTPVTTWENVPYLGKREDQWCGSLIGLTSRATWAQNIPTAIQQVRSLIGNEEFLDYMPSMKRFRKEEESEGAIW

SEQ ID NO: 4934 - protein, 3290 aa, Artificial Sequence
  derived and/or modified protein sequence (wt) from DENV-3__FJ547085__SS-prME
TSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAVLPEEQDQNYVCKHTYVDRGWGNGCGLFGKGSLVTCAKFQCLEPIEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDVPCKIPFSTEDGQGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQADTGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKARIVTAETQNSSFIIDGPNTPECPNTSRAWNVWEVEDYGFGVFTTNIWLKLREVYTQLCDHRLMSAAVKDERAVHADMGYWIESQKNGSWKLEKASLIEVKTCTWPKSHTLWSNGVLESDMIIPKSLAGPISQHNYRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGEVDNFTMGVLCLAILFEEVMRGKFGKKHMIAGVFFTFVLLLSGQITWRDMAHTLIMIGSNATDRMGMGVTYLALIATFKIQPFLALGFFLRKLTSRENLLLGVGLAMATTLQLPEDIEQMANGIALGLMALKLITQFETYQLWTALISLTCSNTIFTLTVAWRTATLILAGVSLLPVCQSSSMRKTDWLPMTVAAMGVPPLPLFIFSLKDTLKRRSWPLNEGVMAVGLVSILASSLLRNDVPMAGPLVAGGLLIACYVITGTSADLTVEKAADVTWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTYNGKRLEPNWASVKKDLISYGGGWRLSAQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKDFAAGRKSIALDLVTEIGRVPTHLAHRTRNALDNLVMLHTSEHGGKAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGEITHHAVSRGTAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPAVIEHLERLQRKHGGMLVRNPLSRNSTHEMYWISNGTGNIVASVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRSMPGTRRVMEITAEWLWRTLGRNKKPRLCTREEFTKKVRTNAAMGAVFTEENQWDSAKAAVEDEDFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPTGTVMDIISRKDQRGSGQVGTYGLNTFTNMEAQLIRQMEGEGVLSKADLENPHLPEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLRETACLGKAYAQMWSLMYFHRRDLRLASNAICSAVPVHWVPTSRTTWSIHAHHQWMTTEDMLTVWNRVWIEDNPWMEDKTPVTTWENVPYLGKREDQWCGSLIGLTSRATWAQNIPTAIQQVRSLIGNEEFLDYMPSMKRFRKEEESEGAIW

SEQ ID NO: 4935 - protein, 3290 aa, Artificial Sequence
  derived and/or modified protein sequence (wt) from DENV-3__EU482595__SS-prME
TSLCLMMMLPAALAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYVGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAVLPEEQDQNYVCKHTYVDRGWGNGCGLFGKGSLVTCAKFQCLEPIEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDVPCKVPFSTEDGQGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIVIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRILTPQPMELKYSWKTWGKAKIVTAETQNSSFIIDGPNTPECPSASRAWNVWEVEDYGFGVFSTNIWLKLREVYTQLCDHRLMSAAVKDERAVHADMGYWIESQKNGSWKLEKASLIEVKTCTWPKSHTLWSNGVLESDMIIPKSLAGPISQHNYRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGKVDNFTMGVLCLAILFEEVMRGKFGKKHMIAGVFFTFVLLLSGQITWRDMAHTLIMIGSNASDRMGMGVTYLALIATFKIQPFLALGFFLRKLTSRENLLLGVGLAMATTLQLPEDIEQMANGIALGLMALKLITQFETYQLWTALISLTCSNTIFTLTVAWRTATLILAGVSLLPVCQSSSMRKTDWLPMTVAAMGVPPLPLFIFSLKDTLKRRSWPLNEGVMAVGLVSILASSLLRNDVPMAGPLVAGGLLIACYVITGTSADLTVEKAADVTWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTYNGKRLEPNWASVKKDLISYGGGWRLSAQWQKGEEVQVIAVEPGKNPKNFQTMPGTFQTTTGEIGAIALDFKPGTSGSPIINREGKVVGLYGNGVVTKNGGYVSGIAQTNAEPDGPAPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKDFAAGRKSIALDLVTEIGRVPSHLAHRTRNALDNLVMLHTSEHGGKAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVASVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRSMPGTRRVMGITAEWLWRTLGRNKKPRLCTREEFTKKVRTNAAMGAVFTEENQWDSAKAAVEDEDFWILVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPTGTVMDIISRKDQRGSGQVGTYGLNTFTNMEAQLIRQMEGEGVLSKADLENPHLPEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLRETACLGKAYAQMWSLMYFHRRDLRLASNAICSAVPVHWVPTSRTTWSIHAHHQWMTTEDMLTVWNRVWIEDNPWMEDKTPVTTWENVPYLGKREDQWCGSLIGLTSRATWAQNIPTAIQQVRSLIGNEEFLDYMPSMKRFRKEEESEGAIW

SEQ ID NO: 4936 - protein, 3290 aa, Artificial Sequence
  derived and/or modified protein sequence (wt) from DENV-3__EU482596__SS-prME
TSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAVLPEEQDQNYVCKHTYVDRGWGNGCGLFGKGSLVTCAKFQCLEPIEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDVPCKIPFSTEDGQGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSASRAWNVWEVEDYGFGVFTTNIWLKLREVYTQLCDHRLMSAAVKDERAVHADMGYWIESQKNGSWKLEKASLIEVKTCTWPKSHTLWSNGVLESDMIIPKSLAGPISQHNYRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGKVDNFTMGVLCLAILFEEVMRGKFGKKHMIAGVFFTFVLLLSGQITWRDMAHTLIMIGSNASDRMGMGVTYLALIATFKIQPFLALGFFLRKLTSRENLLLGVGLAMATTLQLPEDIEQMANGIALGLMALKLITQFETYQLWTALISLTCSNTIFTLTVAWRTATLILAGVSLLPVCQSSSMRKTDWLPMTVAAMGVPPLPLFIFSLKDTLKRRSWPLNEGVMAVGLVSILASSLLRNDVPMAGPLVAGGLLIACYVITGTSADLTVEKAADVTWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTYNGKRLEPNWASVKKDLISYGGGWRLSAQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKDFAAGRKSIALDLVTEIGRVPSHLAHRTRNALDNLVMLHTSEHGGKAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVASVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRSMPGTRRVMGITAEWLWRTLGRNKKPRLCTREEFTKKVRTNAAMGAVFTEENQWDSAKAAVEDEDFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPTGTVMDIISRKDQRGSGQVGTYGLNTFTNMEAQLIRQMEGEGVLSKADLENPHLPEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLRETACLGKAYAQMWSLMYFHRRDLRLASNAICSAVPVHWVPTSRTTWSIHAHHQWMTTEDMLTVWNRVWIEDNPWMEDKTPVTTWENVPYLGKREDQWCGSLIGLTSRATWAQNIPTAIQQVRSLIGNEEFLDYMPSMKRFRKEEESEGAIW

SEQ ID NO: 4937 - protein, 3290 aa, Artificial Sequence
  derived and/or modified protein sequence (wt) from DENV-3__JQ922554__SS-prME
TSLCLMMMLPATLAFHLTSRDGEPRMIVGKNERGKSLLFKTASGINMCTLIAMDLGEMCDDTVTYKCPHITELEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAILPEEQDQNYVCKHTYVDRGWGNGCGLFGKGSLVTCAKFQCLESIEGKVVQHENLKYTVIITVHTGDQHQVGNETQGVTAEITSQASTAEAILPEYGTLGLECSPRTGLDFNEMILLTMKNKAWMVHRQWFFDLPLPWTSGATTKTPTWNRKELLVTFKNAHAKKQEVVVLGSQEGAMHTALTGATEIQTSGGTSIFAGHLKCRLKMDKLELKGMSYAMCLNTFVLKKEVSETQHGTILIKVEYKGEDAPCKIPFSTEDGQGKAHNGRLITANPVVTKKEEPVNIEAEPPFGESNIVIGIGDKALKINWYRKGSSIGKMFEATARGARRMAILGDTAWDFGSVGGVLNSLGKMVHQIFGSAYTALFSGVSWIMKIGIGVLLTWIGLNSKNTSMAFSCIAIGIITLYVGVVVQADMGCVINWKGKELKCGSGIFVTNEVHTWTEQYKFQADSPKRLATAIAGAWENGVCGIRSTTRMENLLWKQIANELNYILWENNIKLTVVVGDITGVLEQGERTLTPQPMELKYSWKTWGKAKIVTAETQNSSFIIDGPSTPECPSASRAWNVWEVEDYGFGVFTTNIWLKLREVYTQLCDHRLMSAAVKDERAVHADMGYWIESQKNGSWKLEKASLIEVKTCTWPKSHTLWSNGVLESDMIIPKSLAGPISQHNHRPGYHTQTAGPWHLGKLELDFNYCEGTTVVISENCGTRGPSLRTTTVSGKLIHEWCCRSCTLPPLRYMGEDGCWYGMEIRPINEKEENMVKSLASAGSGKVDNFTMGVLCLAILFEEVMRGKFRKKHMIAGVLFTFVLLLSGQITWRDMAHTLIMIGSNASDRMGMGVTYLALIATFKIQPFLALGFFLRKLTSRENLLLGVGLAMAATLRLPEDIEQMANGIALGLMALKLITQFETYQLWTALVSLTCSNTIFTLTVAWRTATLILAGISLLPVCQSSSMRKTDWLPMTVAAMGVPPLPLFIFSLKDTLKRRSWPLNEGVMAVGLVSILASSLLRNDVPMAGPLVAGGLLIACYVITGTSADLTVEKAADVTWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTHNGKRLEPNWASVKKDLISYGGGWRLSAQWAKGGETQVIAVEPGKNPKNFQTMPGIFQTTTGEIGAIALDFKPGTSGSPIINREGKVVGLYGNGVVTKNGGYVSGIAQTNAELDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRGSNYNLIIMDEAHFTDPASIAAIGYISTRVGMGEAAAIFMTATPPGTVDAFPQSIPPIQDEERDIPERSWNSGNEWITDFVGKTVWFVPSIKAGNDIANCLRKNGKKVIQLSRKTFDTEYQKTKLNDWDFVVTTDISEMGANFKADRVIYLRRCLKPVILTNGPERVILAGPMPVTVASAAQRRGRVGRNPQKENDQYIFMGQPLNNDEDHAHWTEAKMLLDNINTPEGIIPALFEPEREKSAAIDGEYRLKGESRKTFVELMRRGDLPVWLAHKVASEGIKYTDRKWCFDGERNNQILEENMDVEIWTKEGEKKNWRPRWLDARTYSDPLALKEFKDFAAGRKSIALDLVTEIGRVPSHLAHTVRNALDNLVMLHTSEHGGRAYRHAVEELPETMETLLLLGLMILLTGGAMLFLISGKGIGKTSIGLICVIASSGMLWMADVPLQWIASAIVLEFFMMVLLIPEPEKQRTPQDNQLAYVVIGILTLAAIVAANEMGLLETTKRDLGMSKEPGVVSPTSYLDVDLHPASAWTLYAVATPVITPMLRHTIENSTANVSLAAIANQAVVLMGLDKGWPISKMDLGVPLLALGCYSQVNPLTLAAAVLLLVTHYAIIGPGLQAKATREAQKRTAAGIMKNPTVDGIMTIDLDPVIYDSKFEKQLGQVMLLVLCAVQLLLMRTSWPLCEVLALATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGEITHHAVSRGSAKLQWFVERNMVFPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWVKNNQFCIKVLNPYMPSVIEHLENLQRKHGGILVRNPLSRNSTHEMYWISNGTGNIVSSVNMVSRLLLNRFTMTHRRPTIEKDVDLGAGTRHVNAEPETPNMDVIGERIKRIKEEHSSTWHYDDENPYKTWAYHGSYEVKATGSASSMINGVVKLLTKPWDVVPMVTQMAMTDTTPFGQQRVFKEKVDTRTPRPMPGTRKVMEITAEWLWRTLGRNKRPRLCTREEFTKKVRTNAAMGAVFTEENQWDSARAAVEDEEFWKLVDRERELHKLGKCGSCVYNMMGKREKKLGEFGKAKDSRAIWYMWLGARYLEFEALGFLNEDHWFSRENSYSGVEGEGLHKLGYILRDISKIPGGAMYADDTAGWDTRITEDDLHNEEKITQQMAREHRQLANAIFKLTYQNKVVKVQRPTPKGTVMDIISRKDQRGSGQVGTYGLNTFTNMEAQLIRQMEGEGVLSKADLENPHPLEKKITQWLETKGVERLKRMAISGDDCVVKPIDDRFANALLALNDMGKVRKDIPQWQPSKGWHDWQQVPFCSHHFHELIMKDGRKLVVPCRPQDELLGKARISQGAGWSLRETACLGKAYAQMWTLMYFHRRDLRLASNAICSAVPVHWVPTSRTTWSIHAHHQWMTTEDMLTVWNRVWIEDNPWMEDKTPVTTWEDVPYLGKREDQWCGSLIGLTSRATWAQNILTAIQQVRSLIGNEEFLDYMPSMKRFRKEEESEGAIW

SEQ ID NO: 4938 - protein, 3290 aa, Artificial Sequence
  derived and/or modified protein sequence (wt) from DENV-3__EU529683__SS-prME
TSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAVLPEEQDQNYVCKHTYVDRGWGNGCGLFGKGSLVTCAKFQCLEPIEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDVPCKIPFSTEDGQGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQADTGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKARIVTAETQNSSFIIDGPNTPECPNTSRAWNVWEVEDYGFGVFTTNIWLKLREVYTQLCDHRLMSAAVKDERAVHADMGYWIESQKNGSWKLEKASLIEVKTCTWPKSHTLWSNGVLESDMIIPKSLAGPISQHNYRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGEVDNFTMGVLCLAILFEEVMRGKFGKKHMIAGVFFTFVLLLSGQITWRDMAHTLIMIGSNATDRMGMGVTYLALIATFKIQPFLALGFFLRKLTSRENLLLGVGLAMATTLQLPEDIEQMANGIALGLMALKLITQFETYQLWTALISLTCSNTIFTLTVAWRTATLILAGVSLLPVCQSSSMRKTDWLPMTVAAMGVPPLPLFIFSLKDTLKRRSWPLNEGVMAVGLVSILASSLLRNDVPMAGPLVAGGLLIACYVITGTSADLTVEKAADVTWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTYNGKRLEPNWASVKKDLISYGGGWRLSAQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKDFAAGRKSIALDLVTEIGRVPTHLAHRTRNALDNLVMLHTSEHGGKAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPAVIEHLERLQRKHGGMLVRNPLSRNSTHEMYWISNGTGNIVASVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRSMPGTRRVMEITAEWLWRTLGRNKKPRLCTREEFTKKVRTNAAMGAVFTEENQWDSAKAAVEDEDFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPTGTVMDIISRKDQRGSGQVGTYGLNTFTNMEAQLIRQMEGEGVLSKADLENPHLPEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLRETACLGKAYAQMWSLMYFHRRDLRLASNAICSAVPVHWVPTSRTTWSIHAHHQWMTTEDMLTVWNRVWIEDNPWMEDKTPVTTWENVPYLGKREDQWCGSLIGLTSRATWAQNIPTAIQQVRSLIGNEEFLDYMPSMKRFRKEEESEGAIW

SEQ ID NO: 4939 - protein, 3290 aa, Artificial Sequence
  derived and/or modified protein sequence (wt) from DENV-3__EU529684__SS-prME
TSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAVLPEEQDQNYVCKHTYVDRGWGNGCGLFGKGSLVTCAKFQCLEPIEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDVPCKIPFSTEDGQGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQADMGCVINWKGKELKCGSGIFVTNEVHTWTEQYKFQADSPKKLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSASRAWNVWEVEDYGFGVFTTNIWLKLREVYTQLCDHRLMSAAVKDERAVHADMGYWIESQKNGSWKLEKASLIEVKTCTWPKSHTLWSNGVLESDMIIPKSLAGPISQHNYRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGEVDNFTMGVLCLAILFEEVMRGKFGKKHMIAGVFFTFVLLLSGQITWRDMAHTLIMIGSNASDRMGMGVTYLALIATFKIQPFLALGFFLRKLTSRENLLLGVGLAMATTLQLPEDIEQMANGIALGLMALKLITQFETYQLWTALISLTCSNTIFTLTVAWRTATLILAGVSLLPVCQSSSMRKTDWLPMTVAAMGVPPLPLFIFSLKDTLKRRSWPLNEGVMAVGLVSILASSLLRNDVPMAGPLVAGGLLIACYVITGTSADLTVEKAADVTWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTYNGKRLEPNWASVKKDLISYGGGWRLSAQWQKGEEVQVIAVEPGKNPKNFQTMPGTFQTTTGEIGAIALDFKPGTSGSPIINREGKIVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKDFAAGRKSIALDLVTEIGRVPTHLAHRTRTALDNLVMLHTSEHGGKAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVASVNMVSRLLLNRFTMTHRRPTIEKDVDLGAGTRHVNAEPETPNMDVIGERIKRIKDEHNSTWHYDDENPYKTWAYHGSYEVKATGSASSMINGVVKLLTKPWDVVPMVTQMAMTDTTPFGQQRVFKEKVDTRTPRSMPGTRRVMGITAEWLWRTLGRNKKPRLCTREEFTKKVRTNAAMGAVFTEENQWDSAKAAVEDEDFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPTGTVMDIISRKDQRGSGQVGTYGLNTFTNMEAQLIRQMEGEGVLSKADLENPHLPEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLRETACLGKAYAQMWSLMYFHRRDLRLASNAICSAVPVHWVPTSRTTWSIHAHHQWMTTEDMLTVWNRVWIEDNPWMEDKTPVTTWENVPYLGKREDQWCGSLIGLTSRATWAQNIPTAIQQVRSLIGNEEFLDYMPSMKRFRKEEESEGAIW

SEQ ID NO: 4940 - protein, 3290 aa, Artificial Sequence
  derived and/or modified protein sequence (wt) from DENV-3__FJ182015__SS-prME
TSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAVLPEEQDQNYVCKHTYVDRGWGNGCGLFGKGSLVTCAKFQCLEPIEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDVPCKIPFSTEDGQGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSASRAWNVWEVEDYGFGVFTTNIWLKLREVYTQLCDHRLMSAAVKDERAVHADMGYWIESQKNGSWKLEKASLIEVKTCTWPKSHTLWSNGVLESDMIIPKSLAGPISQHNYRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGEVDNFTMGVLCLAILFEEVMRGKFGKKHMIAGVFFTFVLLLSGQITWRDMAHTLIMIGSNASDRMGMGVTYLALIATFKIQPFLALGFFLRKLTSRENLLLGVGLAMATTLQLPEDIEQMANGIALGLMALKLITQFETYQLWTALISLTCSNTIFTLTVAWRTATLILAGVSLLPVCQSSSMRKTDWLPMTVAAMGVPPLPLFIFSLKDTLKRRSWPLNEGVMAVGLVSILASSLLRNDVPMAGPLVAGGLLIACYVITGTSADLTVEKAADVTWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTYNGKRLEPNWASVKKDLISYGGGWRLSAQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKDFAAGRKSIALDLVTEIGRVPTHLAHRTRNALDNLVMLHTSEHGGKAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVASVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRSMPGTRRVMGITAEWLWRTLGRNKKPRLCTREEFTKKVRTNAAMGAVFTEENQWDSAKAAVEDEDFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPTGTVMDIISRKDQRGSGQVGTYGLNTFTNMEAQLIRQMEGEGVLSKADLENPHLPEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLRETACLGKAYAQMWSLMYFHRRDLRLASNAICSAVPVHWVPTSRTTWSIHAHHQWMTTEDMLTVWNRVWIEDNPWMEDKTPVTTWENVPYLGKREDQWCGSLIGLTSRATWAQNIPTAIQQVRSLIGNEEFLDYMPSMKRFRKEEESEGAIW

SEQ ID NO: 4941 - protein, 3290 aa, Artificial Sequence
  derived and/or modified protein sequence (wt) from DENV-3__EU569688__SS-prME
TSLCLMMILPAALAFHLTSRDGEPRMIVGKNERGKSLLFKTASGINMCTLIAMDLGEMCDDTVTYKCPHITEAEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAVLPEEQDQNYVCKHTYVDRGWGNGCGLFGKGSLVTCAKFQCLEPIEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDVPCKIPFSTEDGQGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDTIGVLEQGKRTLTPQPMELKYSWKTWGKAKIVTAETQNSSFIIDGPNTPECPSASRAWNVWEVEDYGFGVFTTNIWLKLREVYTQLCDHRLMSAAVKDERAVHADMGYWIESQKNGSWKLEKASLIEVKTCTWPKSHTLWSNGVLESDMIIPKSLAGPISQHNYRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGEVDNFTMGVLCLAILFEEVMRGKFGKKHMIAGVFFTFVLLLSGQITWRDMAHTLIMIGSNASDRMGMGVTYLALIATFKIQPFLALGFFLRKLTSRENLLLGVGLAMATTLQLPEDIEQMANGIALGLMALKLITQFETYQLWTALISLTCSNTIFTLTVAWRTATLILAGVSLLPVCQSSSMRKTDWLPMTVAAMGVPPLPLFIFSLKDTLKRRSWPLNEGVMAVGLVSILASSLLRNDVPMAGPLVAGGLLIACYVITGTSADLTVEKAADVTWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTYNGKRLEPNWASVKKDLISYGGGWRLSAQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKDFAAGRKSIALDLVTEIGRVPTHLAHRTRNALDNLVMLHTSEHGGKAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPERCDTLLCDIGESSPSPTVEESRTIRVLKMVEPWLKNNQFCIKVLNPYMPTVIEHLERLQRKHGGMLVRNPLSRNSTHEMYWISNGTGNIVASVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRSMPGTRRVMGITAEWLWRTLGRNKKPRLCTREEFTKKVRTNAAMGAVFTEENQWDSAKAAVEDEDFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPTGTVMDIISRKDQRGSGQVGTYGLNTFTNMEAQLIRQMEGEGVLSKADLENPHLPEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLRETACLGKAYAQMWSLMYFHRRDLRLASNAICSAVPVHWVPTSRTTWSIHAHHQWMTTEDMLTVWNRVWIEDNPWMEDKTPVTTWENVPYLGKREDQWCGSLIGLTSRATWAQNIPTAIQQVRSLIGNEEFLDYMPSMKRFRKEEESEGAIW

SEQ ID NO: 4942 - protein, 3290 aa, Artificial Sequence
  derived and/or modified protein sequence (wt) from DENV-3__EU529686__SS-prME
TSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAVLPEEQDQNYVCKHTYVDRGWGNGCGLFGKGSLVTCAKFQCLEPIEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDVPCKIPFSTEDGQGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSASRAWNVWEVEDYGFGVFTTNIWLKLREVYTQLCDHRLMSAAVKDERAVHADMGYWIESQKNGSWKLEKASLIEVKTCTWPKSHTLWSNGVLESDMIIPKSLAGPISQHNYRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGEVDNFTMGVLCLAILFEEVMRGKFGKKHMIAGVFFTFVLLLSGQITWRDMAHTLIMIGSNASDRMGMGVTYLALIATFKIQPFLALGFFLRKLTSRENLLLGVGLAMATTLQLPEDIEQMANGIALGLMALKLITQFETYQLWTALISLTCSNTIFTLTVAWRTATLILAGVSLLPVCQSSSMRKTDWLPMTVAAMGVPPLPLFIFSLKDTLKRRSWPLNEGVMAVGLVSILASSLLRNDVPMAGPLVAGGLLIACYVITGTSADLTVEKAADVTWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTYNGKRLEPNWASVKKDLISYGGGWRLSAQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKDFAAGRKSIALDLVTEIGRVPTHLAHRTRNALDNLVMLHTSEHGGKAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVASVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRSMPGTRRVMGITAEWLWRTLGRNKKPRLCTREEFTKKVRTNAAMGAVFTEENQWDSAKAAVEDENFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPTGTVMDIISRKDQRGSGQVGTYGLNTFTNMEAQLIRQMEGEGVLSKADLENSHLPEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLRETACLGKAYAQMWSLMYFHRRDLRLASNAICSAVPVHWVPTSRTTWSIHAHHQWMTTEDMLTVWNRVWIEDNPWMEDKTPVTTWENVPYLGKREDQWCGSLIGLTSRATWAQNIPTAIQQVRSLIGNEEFLDYMPSMKRFRKEEESEGAIW

SEQ ID NO: 4943 - protein, 3290 aa, Artificial Sequence
  derived and/or modified protein sequence (wt) from DENV-3__EU529687__SS-prME
TSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAVLPEEQDQNYVCKHTYVDRGWGNGCGLFGKGSLVTCAKFQCLEPIEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDVPCKIPFSTEDGQGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSASRAWNVWEVEDYGFGVFTTNIWLKLREVYTQLCDHRLMSAAVKDERAVHADMGYWIESQKNGSWKLEKASLIEVKTCTWPKSHTLWSNGVLESDMIIPKSLAGPISQHNYRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGEVDNFTMGVLCLAILFEEVMRGKFGKKHMIAGVFFTFVLLLSGQITWRDMAHTLIMIGSNASDRMGMGVTYLALIATFKIQPFLALGFFLRKLTSRENLLLGVGLAMATTLQLPEDIEQMANGIALGLMALKLITQFETYQLWTALISLTCSNTIFTLTVAWRTATLILAGVSLLPVCQSSSMRKTDWLPMTVAAMGVPPLPLFIFSLKDTLKRRSWPLNEGVMAVGLVSILASSLLRNDVPMAGPLVAGGLLIACYVITGTSADLTVEKAADVTWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTYNGKRLEPNWASVKKDLISYGGGWRLSAQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEEKDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKDFAAGRKSIALDLVTEIGRVPSHLAHRTRNALDNLVMLHTSEHGGKAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVASVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRSMPGTRRVMGITAEWLWRTLGRNKKPRLCTREEFTKKVRTNAAMGAVFTEENQWDSAKAAVEDEDFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPTGTVMDIISRKDQRGSGQVGTYGLNTFTNMEAQLIRQMEGEGVLSKADLENPHLPEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLRETACLGKAYAQMWSLMYFHRRDLRLASNAICSAVPVHWVPTSRTTWSIHAHHQWMTTEDMLTVWNRVWIEDNPWMEDKTPVTTWENVPYLGKREDQWCGSLIGLTSRATWAQNIPTAIQQVRSLIGNEEFLDYMPSMKRFRKEEESEGAIW

SEQ ID NO: 4944 - protein, 3290 aa, Artificial Sequence
  derived and/or modified protein sequence (wt) from DENV-3__KF955449__SS-prME
TSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFVLLMLVTPSMTMRCVGVGNRDFVEGLSGATWVDVVLEHGGCVTTMAKNKPTLDIELQKTEATQLATLRKLCIEGKITNITTDSRCPTQGEAVLPEEQDQNYVCKHTYVDRGWGNGCGLFGKGSLVTCAKFQCLEPIEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDVPCKIPFSTEDGQGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSASRAWNVWEVEDYGFGVFTTNIWLKLREVYTQLCDHRLMSAAVKDERAVHADMGYWIESQKNGSWKLEKASLIEVKTCTWPKSHTLWSNGVLESDMIIPKSLAGPISQHNYRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGEVDNFTMGVLCLAILFEEVMRGKFGKKHMIAGVFFTFVLLLSGQITWRDMAHTLIMIGSNASDRMGMGVTYLALIATFKIQPFLALGFFLRKLTSRENLLLGVGLAMATTLQLPEDIEQMANGIALGLMALKLITQFETYQLWTALISLTCSNTIFTLTVAWRTATLILAGVSLLPVCQSSSMRKTDWLPMTVAAMGVPPLPLFIFSLKDTLKRRSWPLNEGVMAVGLVSILASSLLRNDVPMAGPLVAGGLLIACYVITGTSADLTVEKAADVTWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTYNGKRLEPNWASVKKDLISYGGGWRLSAQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKDFAAGRKSIALDLVTEIGRVPSHLAHRTRNALDNLVMLHTSEHGGKAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVASVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRSMPGTRRVMGITAEWLWRTLGRNKKPRLCTREEFTKKVRTNAAMGAVFTEENQWDSAKAAVEDEDFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPTGTVMDIISRKDQRGSGQVGTYGLNTFTNMEAQLIRQMEGEGVLSKADLENPHLPEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLRETACLGKAYAQMWSLMYFHRRDLRLASNAICSAVPVHWVPTSRTTWSIHAHHQWMTTEDMLTVWNRVWIEDNPWMEDKTPVTTWENVPYLGKREDQWCGSLIGLTSRATWAQNIPTAIQQVRSLIGNEEFLDYMPSMKRFRKEEESEGAIW

SEQ ID NO: 4945 - protein, 3290 aa, Artificial Sequence
  derived and/or modified protein sequence (wt) from DENV-3__FJ373303__SS-prME
TSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAVLPEEQDQNYVCKHTYVDRGWGNGCGLFGKGSLVTCAKFQCLEPIEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDVPCKIPFSTEDGQGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQADMGCVINWKGKELKCGSGIFVTNEVHTWTEQYKFQADSPKRLATAIAGAWENGVCGIRSTTRMENLLWKQIANELNYILWENNVKLTVVVGDIIGVLEQGKRTLTPQPMELKYSWKTWGKAKIVTAETQNSSFIIDGPNTPECPSASRAWNVWEVEDYGFGVFTTNIWLKLREVYTQLCDHRLMSAAVKDERAVHADMGYWIESQKNGSWKLEKASLIEVKTCTWPKSHTLWSNGVLESDMIIPKSLAGPISQHNYRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGEVDNFTMGVLCLAILFEEVMRGKFGKKHMIAGVFFTFVLLLSGQITWRDMAHTLIMIGSNASDRMGMGVTYLALIATFKIQPFLALGFFLRKLTSRENLLLGVGLAMATTLQLPEDIEQMANGIALGLMALKLITQFETYQLWTALISLTCSNTIFTLTVAWRTATLILAGVSLLPVCQSSSMRKTDWLPMTVAAMGVPPLPLFIFSLKDTLKRRSWPLNEGVMAVGLVSILASSLLRNDVPMAGPLVAGGLLIACYVITGTSADLTVEKAADVTWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTYNGKRLEPNWASVKKDLISYGGGWRLSAQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKDFAAGRKSIALDLVTEIGRVPSHLAHRTRNALDNLVMLHTSEHGGKAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNVVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVASVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRSMPGTRRVMGITAEWLWRTLGRNKKPRLCTREEFTKKVRTNAAMGAVFTEENQWDSAKAAVEDEDFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPTGTVMDIISRKDQRGSGQVGTYGLNTFTNMEAQLIRQMEGEGVLSKADLENPHLPEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLRETACLGKAYAQMWSLMYFHRRDLRLASNAICSAVPVHWVPTSRTTWSIHAHHQWMTTEDMLTVWNRVWIEDNPWMEDKTPVTTWENVPYLGKREDQWCGSLIGLTSRATWAQNIPTAIQQVRSLIGNEEFLDYMPSMKRFRKEEESEGAIW

SEQ ID NO: 4946 - protein, 3290 aa, Artificial Sequence
  derived and/or modified protein sequence (wt) from DENV-3__KF955451__SS-prME
TSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAVLPEEQDQNYVCKHTYVDRGWGNGCGLFGKGSLVTCAKFQCLEPIEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDVPCKIPFSTEDGQGKAHNGRLITANPVVTKKEEPVNIEAEPPFGESNIVIGVGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGVVVQADMGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSASRAWNVWEVEDYGFGVFTTNIWLKLREVYTQLCDHRLMSAAVKDERAVHADMGYWIESQKNGSWKLEKASLIEVKTCTWPKSHTLWSNGVLESDMIIPKSLAGPISQHNYRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGEVDNFTMGVLCLAILFEEVMRGKFGKKHMIAGVFFTFVLLLSGQITWRDMAHTLIMIGSNASDRMGMGVTYLALIATFKIQPFLALGFFLRKLTSRENLLLGVGLAMATTLQLPEDVEQMANGIALGLMALKLITQFETYQLWTALISLTCSNTIFTLTVAWRTATLILAGVSLLPVCQSSSMRKTDWLPMTVAAMGVPPLPLFIFSLKDTLKRRSWPLNEGVMAVGLVSILASSLLRNDVPMAGPLVAGGLLIACYVITGTSADLTVEKAADVTWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTYNGKRLEPNWASVKKDLISYGGGWRLNAQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKDFAAGRKSIALDLVTEIGRVPTHLAHRTRSALDNLVMLHTSEHGGKAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKRKLNQLSRKEFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVASVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRPMPGTRRVMGITAEWLWRTLGRNKKPRLCTREEFTKKVRTNAAMGAVFTEENQWDSAKAAVEDEDFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPTGTVMDIISRKDQRGSGQVGTYGLNTFTNMEAQLIRQMEGEGVLSKADLENPHLSEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLRETACLGKAYAQMWSLMYFHRRDLRLASNAICSAVPVHWVPTSRTTWSIHAHHQWMTTEDMLTVWNRVWIEDNPWMEDKTPVTTWENVPYLGKREDQWCGSLIGLTSRATWAQNIPTAIQQVRSLIGNEEFLDYMPSMKRFRKEEESEGAIW

SEQ ID NO: 4947 - protein, 3290 aa, Artificial Sequence
  derived and/or modified protein sequence (wt) from DENV-3__KF955453__SS-prME
TSLCLMMILPATLAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAVLPEEQDQNYVCKHTYVDRGWGNGCGLFGKGSLVTCAKFQCLEPIEGKVVQYENLKYTVIITVHTGDQHQVGNETQGVTAEITPQASTTEATLPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDVPCKIPFSTEDGQGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSASRAWNVWEVEDYGFGVFTTNIWLKLREVYTQLCDHRLMSAAVKDERAVHADMGYWIESQKNGSWKLEKASLIEVKTCTWPKSHTLWSNGVLESDMIIPKSLAGPISQHNYRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGEVDNFTMGVLCLAILFEEVMRGKFGKKHMIAGVFFTFVLLLSGQITWRDMAHTLIMIGSNASDRMGMGVTYLALIATFKIQPFLALGFFLRKLTSRENLLLGVGLAMATTLQLPEDIEQMANGIALGLMALKLITQFETYQLWTALISLTCSNTIFTLTVAWRTATLILAGVSLLPVCQSSSMRKTDWLPMTVAAMGVPPLPLFIFNLKDTLKRRSWPLNEGVMAVGLVSILASSLLRNDVPMAGPLVAGGLLIACYVITGTSADLTVEKAADVTWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTYNGKRLEPNWASVKKDLISYGGGWRLSAQWQKGEEVQVIAVEPGKNPKNFQTMPGTFQTTTGEIGAIALDFKPGTSGSPIINREGKIVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKDFAAGRKSIALDLVTEIGRVPTHLAHRTRNALDNLVMLHTSEHGGKAYRHAVEELPETMETLLLLGLMISLTGGAMLFLISGKGIGKTSIGLICVIASSGMLWMAEIPLQWIASAIVLEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVASVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRSMPGTRRVMGITAEWLWRTLGRNKKPRLCTREEFTKKVRTNAAMGAVFTEENQWDSAKAAVEDEDFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPTGTVMDIISRKDQRGSGQVGTYGLNTFTNMEAQLIRQMEGEGVLSKADLENPHLPEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLRETACLGKAYAQMWSLMYFHRRDLRLASNAICSAVPVHWVPTSRTTWSIHAHHQWMTTEDMLTVWNRVWIEDNPWMEDKTPVTTWENVPYLGKREDQWCGSLIGLTSRATWAQNIPTAIQQVRSLIGNEEFLDYMPSMKRFRKEEESEGAIW

SEQ ID NO: 4948 - protein, 3290 aa, Artificial Sequence
  derived and/or modified protein sequence (wt) from DENV-3__FJ373304__SS-prME
TSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAVLPEEQDQNYVCKHTYVDRGWGNGCGLFGKGSLVTCAKFQCLEPIEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDVPCKIPFSTEDGQGKAHNGRLITANPVVTKKEEPVNIEAEPPFGESNIVIGIGDNALKINWYKKGSSIGKMFEATARGARRMAILGDTAWDFGSVGGVLNSLGKVVHQIFGSAYTALFSGVSWVMKIGIGVLLTWIGLNSKNTSMSFSCIAIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDTIGVLEQGKRTLTPQPMELKYSWKTWGKAKIVTAETQNSSFIIDGPNTPECPSASRAWNVWEVEDYGFGVFTTNIWLKLREVYTQLCDHRLMSAAVKDERAVHADMGYWIESQKNGSWKLEKASLIEVKTCTWPKSHTLWSNGVLESDMIIPKSLAGPISQHNYRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGEVDNFTMGVLCLAILFEEVMRGKFGKKHMIAGVFFTFVLLLSGQITWRDMAHTLIMIGSNASDRMGMGVTYLALIATFKIQPFLALGFFLRKLTSRENLLLGVGLAMATTLQLPEDIEQMANGIALGLMALKLITQFETYQLWTALISLTCSNTIFTLTVAWRTATLILAGVSLLPVCQSSSMRKTDWLPMTVAAMGVPPLPLFIFSLKDTLKRRSWPLNEGVMAVGLVSILASSLLRNDVPMAGPLVAGGLLIACYVITGTSADLTVEKAADVTWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTYNGKRLEPNWASVKKDLISYGGGWRLSAQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKDFAAGRKSIALDLVTEIGRVPTHLAHRTRNALDNLVMLHTSEHGGKAYRHAVEELPETMETLLLLGLMILLTGGAMLFLISGKGIGKTSIGLICVIASSGMLWMAEIPLQWIASAIILEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVASVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRSMPGTRRVMGITAEWLWRTLGRNKKPRLCTREEFTKKVRTNAAMGAVFTEENQWDSAKAAVEDEDFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPTGTVMDIISRKDQRGSGQVGTYGLNTFTNMEAQLIRQMEGEGVLSKADLENPHLPEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLRETACLGKAYAQMWSLMYFHRRDLRLASNAICSAVPVHWVPTSRTTWSIHAHHQWMTTEDMLTVWNRVWIEDNPWMEDKTPVTTWENVPYLGKREDQWCGSLIGLTSRATWAQNIPTAIQQVRSLIGNEEFLDYMPSMKRFRKEEESEGAIW

SEQ ID NO: 4949 - protein, 3290 aa, Artificial Sequence
  derived and/or modified protein sequence (wt) from DENV-3__EU854291__SS-prME
TSLCLMMILPAALAFHLTSRDGEPRMIVGKNERGKSLLFKTASGINMCTLIAMDLGEMCDDTITYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAVLPEEQDQNYVCKHTYVDRGWGNGCGLFGKGSLVTCAKFQCLEPIEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDVPCKIPFSTEDGQGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDTIGVLEQGKRTLTPQPMELKYSWKTWGKAKIVTAETQNSSFIIDGPNTPECPSASRAWNVWEVEDYGFGVFTTNIWLKLREVYTQLCDHRLMSAAVKDERAVHADMGYWIESQKNGSWKLEKASLIEVKTCTWPKSHTLWSNGVLESDMIIPKSLAGPISQHNYRPGYHTQTAGPWHLGKLELDFNYCEGTTVVITENCGTRGPSLRTTTVSGKLIHEWCCRSCTLPPLRYMGEDGCWYGMEIRPVSEKEENMVKSLVSAGSGEVDNFTMGVLCLAILFEEVMRGKFGKKHMIAGVFFTFVLLLSGQITWRDMAHTLIMIGSNASDRMGMGVTYLALIATFKIQPFLALGFFLRKLTSRENLLLGVGLAMATTLQLPEDIEQMANGIALGLMALKLITQFETYQLWTALISLTCSNTIFTLTVAWRTATLILAGVSLLPVCQSSSMRKTDWLPMTVAAMGVPPLPLFIFSLKDTLKRRSWPLNEGVMAVGLVSILASSLLRNDVPMAGPLVAGGLLIACYVITGTSADLTVEKAADVTWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTYNGKRLEPNWASVKKDLISYGGGWRLSAQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGSERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKDFAAGRKSIALDLVTEIGRVPTHLAHRTRNALDNLVMLHTSEHGGKAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAATIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVASVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRPMPGTRRVMGITAEWLWRTLGRNKKPRLCTREEFTKKVRTNAAMGAVFTEENQWDSAKAAVEDEDFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPTGTVMDIISRKDQRGSGQVGTYGLNTFTNMEAQLIRQMEGEGVLSKADLENPHLPEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLRETACLGKAYAQMWSLMYFHRRDLRLASNAICSAVPVHWVPTSRTTWSIHAHHQWMTTEDMLTVWNRVWIEDNPWMEDKTPVTTWENVPYLGKREDQWCGSLIGLTSRATWAQNIPTAIQQVRSLIGNEEFLDYMPSMKRFRKEEESEGAIW

SEQ ID NO: 4950 - protein, 3290 aa, Artificial Sequence
  derived and/or modified protein sequence (wt) from DENV-3__KF955454__SS-prME
TSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAVLPEEQDQNYVCKHTYVDRGWGNGCGLFGKGSLVTCAKFQCLEPIEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDVPCKIPFSTEDGQGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSASRAWNVWEVEDYGFGVFTTNIWLKLREVYTQLCDHRLMSAAVKDERAVHADMGYWIESQKNGSWKLEKASLIEVKTCTWPKSHTLWSNGVLEGDMIIPKSLAGPISQHNYRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGEVDNFTMGVLCLAILFEEVMRGKFGKKHMIAGVFFTFVLLLSGQITWRDMAHTLIMIGSNASDRMGMGVTYLALIATFKIQPFLALGFFLRKLTSRENLLLGVGLAMATTLQLPEDIEQMANGIALGLMALKLITQFETYQLWTALISLTCSNTIFTLTVAWRTATLILAGVSLLPVCQSSSMRKTDWLPMTVAAMGVPPLPLFIFSLKDTLKRRSWPLNEGVMAVGLVSILASSLLRNDVPMAGPLVAGGLLIACYVITGTSADLTVEKAADVTWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTYNGKRLEPNWASVKKDLISYGGGWRLSAQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFLELMRRGDLPVWLAYKVASEGIKYTDRKWCFDGQRNNQILEENMDVEIWTKEGEKKKLRPRWLDARTYSDPLALKEFKDFAAGRKSIALDLVTEIGRVPTHLAHRTRNALDNLVMLHTSEHGGKAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRAEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVASVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRSMPGTRRVMGITAEWLWRTLGRNKKPRLCTREEFTKKVRTNAAMGAVFTEENQWDSAKAAVEDEDFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPTGTVMDIISRKDQRGSGQVGTYGLNTFTNMEAQLIRQMEGEGVLSKADLENPHPPEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLRETACLGKAYAQMWSLMYFHRRDLRLASNAICSAVPVHWVPTSRTTWSIHAHHQWMTTEDMLTVWNRVWIEDNPWMEDKTPVTTWENVPYLGKREDQWCGSLIGLTSRATWAQNIPTAIQQVRSLIGNEEFLDYMPSMKRFRKEEESEGAIW

SEQ ID NO: 4951 - protein, 3290 aa, Artificial Sequence
  derived and/or modified protein sequence (wt) from DENV-3__EU854292__SS-prME
TSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGIGNRDFVEGLSGATWVDVVLEHGGCVTTMAKNKPTLDIELQKTEATQLATLRKLCIEGKITNITTDSRCPTQGEAALPEEQDQNYVCKHTYVDRGWGNGCGLFGKGSLVTCAKFQCLEPIEGKVVQHENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDAPCKIPFSTEDGQGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSAARAWNVWEVEDYGFGVFTTNIWLKLREVYTQLCDHRLMSAAVKDERAVHADMGYWIESQKNGSWKLEKASLIEVKTCTWPKSHTLWSNGVLESDMIIPKSLAGPISQHNHRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGKVDNFTMGVLCLAILFEEVMRGKFGKKHMIAGVFFTFVLLLSGQITWRDMAHTLIMIGSNASDRMGMGVTYLALIATFKIQPFLALGFFLRKLTSRENLLLGVGLAMATTLQLPEDIEQMANGIALGLMALKLITQFETYQLWTALISLTCSNTIFTLTVAWRTATLILAGVSLLPVCQSSSMRKTDWLPMAVAAMGVPPLPLFIFCLKDTLKRRSWPLNEGVMAVGLVSILASSLLRNDVPMAGPLVAGGLLIACYVITGTSADLTVEKAADITWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTYNGKRLEPNWASVKKDLISYGGGWRLSAQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPHKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKDFAAGRKSIALDLVTEIGRVPSHLAHRTRNALDNLVMLHTSEHGGRAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVASVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRSMPGTRRVMGITAEWLWRTLGRNKKPRLCTREEFTKKVRTNAAMGAVFTEENQWDSAKAAVEDEDFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPTGTVMDIISRKDQRGSGQVGTYGLNTFTNMEAQLIRQMEGEGVLSKADLENPHLPEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLKETACLGKAYAQMWSLMYFHRRDLRLASNAICSAVPVHWVPTSRTTWSIHAHHQWMTTEDMLTVWNRVWIEDNPWMEDKTPVTTWENVPYLGKREDQWCGSLIGLTSRATWAQNIPTAIQQVRSLIGNEEFLDYMPSMKRFRKEEESEGAIW

SEQ ID NO: 4952 - protein, 3290 aa, Artificial Sequence
  derived and/or modified protein sequence (wt) from DENV-3__FJ639746__SS-prME
TSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAVLPEEQDQNYVCKHTYVDRGWGNGCGLFGKGSLVTCAKFQCLEPIEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDVPCKIPFSTEDGQGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSASRAWNVWEVEDYGFGVFTTNIWLKLREVYTQLCDHRLMSAAVKDERAVHADMGYWIESQKNGSWKLEKASLIEVKTCTWPKSHTLWSNGVLESDMIIPKSLAGPISQHNYRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGEVDNFTMGVLCLAILFEEVMRGKFGKKHMIAGVFFTFVLLLSGQITWRDMAHTLIMIGSNASDRMGMGVTYLALIATFKIQPFLALGFFLRKLTSRENLLLGVGLAMATTLQLPEDIEQMANGIALGLMALKLITQFETYQLWTALISLTCSNTIFTLTVAWRTATLILAGVSLLPVCQSSSMRKTDWLPMTVAAMGVPPLPLFIFSLKDTLKRRSWPLNEGVMAVGLVSILASSLLRNDVPMAGPLVAGGLLIACYVITGTSADLTVEKAADVTWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTYNGKRLEPNWASVKKDLISYGGGWRLSAQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKDFAAGRKSIALDLVTEIGRVPSHLAHRTRNALDNLVMLHTSEHGGKAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVVEHLERLQRKHGGMLVRNPLSRNSTHEMYWISNGTGNIVASVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRSMPGTRRVMGITAEWLWRTLGRNKKPRLCTREEFTKKVRTNAAMGAVFTEENQWDSAKAAVEDEDFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPTGTVMDIISRKDQRGSGQVGTYGLNTFTNMEAQLIRQMEGEGVLSKADLENPRLPEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLRETACLGKAYAQMWSLMYFHRRDLRLASNAICSAVPVHWVPTSRTTWSIHAHHQWMTTEDMLTVWNRVWIEDNPWMEDKTPITTWENVPYLGKREDQWCGSLIGLTSRATWAQNIPTAIQQVRSLIGNEEFLDYMPSMKRFRKEEESEGAIW

SEQ ID NO: 4953 - protein, 3290 aa, Artificial Sequence
  derived and/or modified protein sequence (wt) from DENV-3__FJ639750__SS-prME
TSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAVLPEEQDQNYVCKHTYVDRGWGNGCGLFGKGSLVTCAKFQCLEPIEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDVPCKIPFSTEDGQGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSASRAWNVWEVEDYGFGVFTTNIWLKLREVYTQLCDHRLMSAAVKDERAVHADMGYWIESQKNGSWKLEKASLIEVKTCTWPKSHTLWSNGVLESDMIIPKSLAGPISQHNYRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGEVDNFTMGVLCLAILFEEVMRGKFGKKHMIAGVFFTFVLLLSGQITWRDMAHTLIMIGSNASDRMGMGVTYLALIATFKIQPFLALGFFLRKLTSRENLLLGVGLAMATTLQLPEDIEQMANGIALGLMALKLITQFETYQLWTALISLTCSNTIFTLTVAWRTATLILAGVSLLPVCQSSSMRKTDWLPMTVAAMGVPPLPLFIFSLKDTLKRRSWPLNEGVMAVGLVSILASSLLRNDVPMAGPLVAGGLLIACYVITGTSADLTVEKAADVTWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTYNGKRLEPNWASVKKDLISYGGGWRLSAQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKDFAAGRKSIALDLVTEIGRVPSHLAHRTRNALDNLVMLHTSEHGGKAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVASVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRSMPGTRRVMGITAEWLWRTLGRNKKPRLCTREEFTKKVRTNAAMGAVFTEENQWDSAKAAVEDEDFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPTGTVMDIISRKDQRGSGQVGTYGLNTFTNMEAQLIRQMEGEGVLSKADLENPHLPEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLRETACLGKAYAQMWSLMYFHRRDLRLASNAICSAVPVHWVPTSRTTWSIHAHHQWMTTEDMLTVWNRVWIEDNPWMEDKTPVTTWENVPYLGKREDQWCGSLIGLTSRATWAQNIPTAIQQVRSLIGNEEFLDYMPSMKRFRKEEESEGAIW

SEQ ID NO: 4954 - protein, 3290 aa, Artificial Sequence
  derived and/or modified protein sequence (wt) from DENV-3__FJ639754__SS-prME
TSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAVLPEEQDQNYVCKHTYVDRGWGNGCGLFGKGSLVTCAKFQCLEPIEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDVPCKIPFSTEDGQGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSASRAWNVWEVEDYGFGVFTTNIWLKLREVYTQLCDHRLMSAAVKDERAVHADMGYWIESQKNGSWKLEKASLIEVKTCTWPKSHTLWSNGVLESDMIIPKSLAGPISQHNYRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGEVDNFTMGVLCLAILFEEVMRGKFGKKHMIAGVFFTFVLLLSGQITWRDMAHTLIMIGSNASDRMGMGVTYLALIATFKIQPFLALGFFLRKLTSRENLLLGVGLAMATTLQLPEDIEQMANGIALGLMALKLITQFETYQLWTALISLTCSNTIFTLTVAWRTATLILAGVSLLPVCQSSSMRKTDWLPMTVAAMGVPPLPLFIFSLKDTLKRRSWPLNEGVMAVGLVSILASSLLRNDVPMAGPLVAGGLLIACYVITGTSADLTVEKAADVTWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTYNGKRLEPNWASVKKDLISYGGGWRLSAQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKDFAAGRKSIALDLVTEIGRVPSHLAHRTRNALDNLVMLHTSEHGGKAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGNYLAGAGLAFSIMKSVGTGKRGTGSQGETLGEKWKKKLNQLSRKEFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVASVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRSMPGTRRVMGITAEWLWRTLGRNKKPRLCTREEFTKKVRTNAAMGAVFTEENQWDSAKAAVEDEDFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPTGTVMDIISRKDQRGSGQVGTYGLNTFTNMEAQLIRQMEGEGVLSKADLENPHLPEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLRETACLGKAYAQMWSLMYFHRRDLRLASNAICSAVPVHWVPTSRTTWSIHAHHQWMTTEDMLTVWNRVWIEDNPWMEDKTPVTTWENVPYLGKREDQWCGSLIGLTSRATWAQNIPTAIQQVRSLIGNEEFLDYMPSMKRFRKEEESEGAIW

SEQ ID NO: 4955 - protein, 3290 aa, Artificial Sequence
  derived and/or modified protein sequence (wt) from DENV-3__FJ639757__SS-prME
TSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAVLPEEQDQNYVCKHTYVDRGWGNGCGLFGKGSLVTCAKFQCLEPIEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDVPCKIPFSTEDGQGKAHNGRLITANPVVTKKEEPVNIEAEPPFGESNIVIGIGDSALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSASRAWNVWEVEDYGFGVFTTNIWLKLREVYTQLCDHRLMSAAVKDERAVHADMGYWIESQKNGSWKLEKASLIEVKTCTWPKSHTLWSNGVLESDMIIPKSLAGPISQHNYRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGEVDNFTMGVLCLAILFEEVMRGKFGKKHMIAGVFFTFVLLLSGQITWRDMAHTLIMIGSNASDRMGMGVTYLALIATFKIQPFLALGFFLRKLTSRENLLLGVGLAMATTLQLPEDIEQMANGIALGLMALKLITQFETYQLWTALISLTCSNTIFTLTVAWRTATLILAGVSLLPVCQSSSMRKTDWLPMTVAAMGVPPLPLFIFSLKDTLKRRSWPLNEGVMAVGLVSILASSLLRNDVPMAGPLVAGGLLIACYVITGTSADLTVEKAADVTWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTYNGKRLEPNWASVKKDLISYGGGWRLSAQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKDFAAGRKSIALDLVTEIGRVPTHLAHRTRNALDNLVMLHTSEHGGKAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVASVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRSMPGTRRVMGITAEWLWRTLGRNKKPRLCTREEFTKKVRTNAAMGAVFTEENQWDSAKAAVEDEDFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPTGTVMDIISRKDQRGSGQVGTYGLNTFTNMEAQLIRQMEGEGVLSKADLENPHLPEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLRETACLGKAYAQMWSLMYFHRRDLRLASNAICSAVPVHWVPTSRTTWSIHAHHQWMTTEDMLTVWNRVWIEDNPWMEDKTPVTTWENVPYLGKREDQWCGSLIGLTSRATWAQNIPTAIQQVRSLIGNEEFLDYMPSMKRFRKEEESEGAIW

SEQ ID NO: 4956 - protein, 3290 aa, Artificial Sequence
  derived and/or modified protein sequence (wt) from DENV-3__FJ639758__SS-prME
TSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAVLPEEQDQNYVCKHTYVDRGWGNGCGLFGKGSLVTCAKFQCLEPIEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDVPCKIPFSTEDGQGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDVIGVLEQGKRTLTPQPMELKYSWKTWGKAKIVTAETQNSSFIIDGPNTPECPSASRAWNVWEVEDYGFGVFTTNIWLKLREVYTQLCDHRLMSAAVKDERAVHADMGYWIESQKNGSWKLEKASLIEVKTCTWPKSHTLWSNGVLESDMIIPKSLAGPISQHNYRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGEVDNFTMGVLCLAILFEEVMRGKFGKKHMIAGVFFTFVLLLSGQITWRDMAHTLIMIGSNASDRMGMGVTYLALIATFKIQPFLALGFFLRKLTSRENLLLGVGLAMATTLQLPEDIEQMANGIALGLMALKLITQFETYQLWTALISLTCSNTIFTLTVAWRTATLILAGVSLLPVCQSSSMRKTDWLPMTVAAMGVPPLPLFIFSLKDTLKRRSWPLNEGVMAVGLVSILASSLLRNDVPMAGPLVAGGLLIACYVITGTSADLTVEKAADVTWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTYNGKRLEPNWASVKKDLISYGGGWRLSAQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKDFAAGRKSIALDLVTEIGRVPSHLAHRTRNALDNLVMLHTSEHGGKAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVVEHLERLQRKHGGMLVRNPLSRNSTHEMYWISNGTGNIVASVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRSMPGTRRVMGITAEWLWRTLGRNKKPRLCTREEFTKKVRTNAAMGAVFTEENQWDSAKAAVEDEDFWKLVDRERELHKLGRCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPTGTVMDIISRKDQRGSGQVGTYGLNTFTNMEAQLIRQMEGEGVLSKADLENPRLPEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLRETACLGKAYAQMWSLMYFHRRDLRLASNAICSAVPVHWVPTSRTTWSIHAHHQWMTTEDMLTVWNRVWIEDNPWMEDKTPVTTWENVPYLGKREDQWCGSLIGLTSRATWAQNIPTAIQQVRSLIGNEEFLDYMPSMKRFRKEEESEGAIW

SEQ ID NO: 4957 - protein, 3290 aa, Artificial Sequence
  derived and/or modified protein sequence (wt) from DENV-3__FJ639759__SS-prME
TSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAVLPEEQDQNYVCKHTYVDRGWGNGCGLFGKGSLVTCAKFQCLEPIEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDVPCKIPFSTEDGQGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDTIGVLEQGKRTLTPQPMELKYSWKTWGKAKIVTAETQNSSFIIDGPNTPECPSASRAWNVWEVEDYGFGVFTTNIWLKLREVYTQLCDHRLMSAAVKDERAVHADMGYWIESQKNGSWKLEKASLIEVKTCTWPKSHTLWSNGVLESDMIIPKSLAGPISQHNYRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGEVDNFTMGVLCLAILFEEVMRGKFGKKHMIAGVLFTFVLLLSGQITWRDMAHTLIMIGSNASDRMGMGVTYLALIATFKIQPFLALGFFLRKLTSRENLLLGVGLAMATTLQLPEDIEQMANGIALGLMALKLITQFETYQLWTALISLTCSNTIFTLTVAWRTATLILAGVSLLPVCQSSSMRKTDWIPMTVAAMGVPPLPLFIFSLKDTLKRRSWPLNEGVMAVGLVSILASSLLRNDVPMAGPLVAGGLLIACYVITGTSADLTVEKAADVTWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTYNGKRLEPNWASVKKDLISYGGGWRLSAQWQKGEEVQVIAVEPGKNPKNFQTMPGTFQTTTGEIGAIALDFKPGTSGSPIINREGKIVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTSATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKDFAAGRKSIALDLVTEIGRVPTHLAHRTRNALDNLVMLHTSEHGGKAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVASVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRSMPGTRRVMGITAEWLWRTLGRNKKPRLCTREEFTKKVRTNAAMGAVFTEENQWDSAKAAVEDEDFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPTGTVMDIISRKDQRGSGQVGTYGLNTFTNMEAQLIRQMEGEGVLSKADLENPHLPEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLRETACLGKAYAQMWSLMYFHRRDLRLASNAICSAVPVHWVPTSRTTWSIHAHHQWMTTEDMLTVWNRVWIEDNPWMEDKTPVTTWENVPYLGKREDQWCGSLIGLTSRATWAQNIPTAIQQVRSLIGNEEFLDYMPSMKRFRKEEESEGAIW

SEQ ID NO: 4958 - protein, 3290 aa, Artificial Sequence
  derived and/or modified protein sequence (wt) from DENV-3__FJ639761__SS-prME
TSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAVLPEEQDQNYVCKHTYVDRGWGNGCGLFGKGSLVTCAKFQCLQPIEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDVPCKIPFSTEDGQGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSASRAWNVWEVEDYGFGVFTTNIWLKLREVYTQLCDHRLMSAAVKDERAVHADMGYWIESQKNGSWKLEKASLIEVKTCTWPKSHTLWSNGVLESDMIIPKSLAGPISQHNYRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGEVDNFTMGVLCLAILFEEVMRGKFGKKHMIAGVFFTFVLLLSGQITWRDMAHTLIMIGSNASDRMGMGVTYLALIATFKIQPFLALGFFLRKLTSRENLLLGVGLAMATTLQLPEDIEQMANGIALGLMALKLITQFETYQLWTALISLTCSNTIFTLTVAWRTATLILAGVSLLPVCQSSSMRKTDWLPMTVAAMGVPPLPLFIFSLKDTLKRRSWPLNEGVMAVGLVSILASSLLRNDVPMAGPLVAGGLLIACYVITGTSADLTVEKAADVTWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTYNGKRLEPNWASVKKDLISYGGGWRLSAQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKDFAAGRKSIALDLVTEIGRVPTHLAHRTRNALDNLVMLHTSEHGGKAYRHAVEELPETMETLLLLGLMILLTGGVMLFLISGKGIGKTSIGLICVIASSGMLWMAEIPLQWIASAIVLEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGLQGETLGEKWKKKLNQLSRKEFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVASVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRSMPGTRRVMGITAEWLWRTLGRNKKPRLCTREEFTKKVRTNAAMGAVFTEENQWDSAKAAVEDEDFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPTGTVMDIISRKDQRGSGQVGTYGLNTFTNMEAQLIRQMEGEGVLSKADLENPHLPEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLRETACLGKAYAQMWSLMYFHRRDLRLASNAICSAVPVHWVPTSRTTWSIHAHHQWMTTEDMLTVWNRVWIEDNPWMEDKTPVTTWENVPYLGKREDQWCGSLIGLTSRATWAQNIPTAIQQVRSLIGNEEFLDYMPSMKRFRKEEESEGAIW

SEQ ID NO: 4959 - protein, 3290 aa, Artificial Sequence
  derived and/or modified protein sequence (wt) from DENV-3__FJ639762__SS-prME
TSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAVLPEEQDQNYVCKHTYVDRGWGNGCGLFGKGSLVTCAKFQCLEPIEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKIEYKGEDVPCKIPFSTEDGQGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSASRAWNVWEVEDYGFGVFTTNIWLKLREVYTQLCDHRLMSAAVKDERAVHADMGYWIESQKNGSWKLEKASLIEVKTCTWPKSHTLWSNGVLESDMIIPKSLAGPISQHNYRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGEVDNFTMGVLCLAILFEEVMRGKFGKKHMIAGIFFTFVLLLSGQITWRDMAHTLIMIGSNASDRMGMGVTYLALIATFKIQPFLALGFFLRKLTSRENLLLGVGLAMATTLQLPEDIEQMANGIALGLMALKLITQFETYQLWTALISLTCSNTIFTLTVAWRTATLILAGVSLLPVCQSSSMRKTDWLPMTVAAMGVPPLPLFIFSLKDTLKRRSWPLNEGVMAVGLVSILASSLLRNDVPMAGPLVAGGLLIACYVITGTSADLTVEKAADVTWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTYNGKRLEPNWASVKKDLISYGGGWRLSAQWQKGEEVQVIAVEPGKNPKNFQTMPGTFQTTTGEIGAIALDFKPGTSGSPIINREGKIVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKDFAAGRKSIALDLVTEIGRVPTHLAHRTRNALDNLVMLHTSEHGGKAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVASVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRSMPGTRRVMGITAEWLWRTLGRNKKPRLCTREEFTKKVRTNAAMGAVFTEENQWDSAKAAVEDEDFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPTGTVMDIISRKDQRGSGQVGTYGLNTFTNMEAQLIRQMEGEGVLSKADLENPHLPEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLRETACLGKAYAQMWSLMYFHRRDLRLASNAICSAVPVHWVPTSRTTWSIHAHHQWMTTEDMLTVWNRVWIEDNPWMEDKTPVTTWENVPYLGKREDQWCGSLIGLTSRATWAQNIPTAIQQVRSLIGNEEFLDYMPSMKRFRKEEESEGAIW

SEQ ID NO: 4960 - protein, 3290 aa, Artificial Sequence
  derived and/or modified protein sequence (wt) from DENV-3__FJ639763__SS-prME
TSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKAVIFILLMLVTPSMTMRCVGVGNRDFVEGLSGATWVDVVLEHGGCVTTMAKNKPTLDIELQKTEATQLATLRKLCIEGKITNITTDSRCPTQGEAVLPEEQDQNYVCKHTYVDRGWGNGCGLFGKGSLVTCAKFQCLEPIEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDVPCKIPFSTEDGQGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSASRAWNVWEVEDYGFGVFTTNIWLKLREVYTQLCDHRLMSAAVKDERAVHADMGYWIESQKNGSWKLEKASLIEVKTCTWPKSHTLWSNGVLESDMIIPKSLAGPISQHNYRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGEVDNFTMGVLCLAILFEEVMRGKFGKKHMIAGVFFTFVLLLSGQITWRDMAHTLIMIGSNASDRMGMGVTYLALIATFKIQPFLALGFFLRKLTSRENLLLGVGLAMATTLQLPEDIEQMANGIALGLMALKLITQFETYQLWTALISLTCSNTIFTLTVAWRTATLILAGVSLLPVCQSSSMRKTDWLPMTVAAMGVPPLPLFIFSLKDTLKRRSWPLNEGVMAVGLVSILASSLLRNDVPMAGPLVAGGLLIACYVITGTSADLTVEKAADVTWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTYNGKRLEPNWASVKKDLISYGGGWRLSAQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKDFAAGRKSIALDLVTEIGRVPSHLAHRTRNALDNLVMLHTSEHGGKAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVASVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRSMPGTRRVMGITAEWLWRTLGRNKKPRLCTREEFTKKVRTNAAMGAVFTEENQWDSAKAAVEDEDFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPTGTVMDIISRKDQRGSGQVGTYGLNTFTNMEAQLIRQMEGEGVLSKADLENPHLPEKKITQWLETNGVERLKRMAISGDDCVVKPIDDRFANALLALNDMGKVRKDIPQWQPSKGWHDWQQVPFCSHHFHELIMKDGRKLVVPCRPQDELIGRARISQGAGWSLRETACLGKAYAQMWSLMYFHRRDLRLASNAICSAVPVHWVPTSRTTWSIHAHHQWMTTEDMLTVWNRVWIEDNPWMEDKTPVTTWENVPYLGKREDQWCGSLIGLTSRATWAQNIPTAIQQVRSLIGNEEFLDYMPSMKRFRKEEESEGAIW

SEQ ID NO: 4961 - protein, 3290 aa, Artificial Sequence
  derived and/or modified protein sequence (wt) from DENV-3__FJ639765__SS-prME
TSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAVLPEEQDQNYVCKHTYVDRGWGNGCGLFGKGSLVTCAKFQCLEPIEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDVPCKIPFSTEDGQGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSASRAWNVWEVEDYGFGVFTTNIWLKLREVYTQLCDHRLMSAAVKDERAVHADMGYWIESQKNGSWKLEKASLIEVKTCTWPKSHTLWSNGVLESDMIIPKSLAGPISQHNYRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGEVDNFTMGVLCLAILFEEVMRGKFGKKHMIAGVFFTFVLLLSGQITWRDMAHTLIMIGSNASDRMGMGVTYLALIATFKIQPFLALGFFLRKLTSRENLLLGVGLAMATTLQLPEDIEQMANGIALGLMALKLITQFETYQLWTALISLTCSNTIFTLTVAWRTATLILAGVSLLPVCQSSSMRKTDWLPMTVAAMGVPPLPLFIFSLKDTLKRRSWPLNEGVMAVGLVSILASSLLRNDVPMAGPLVAGGLLIACYVITGTSADLTVEKAADVTWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTYNGKRLEPNWASVKKDLISYGGGWRLSAQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKDFAAGRKSIALDLVTEIGRVPTHLAHRTRNALDNLVMLHTSEHGGKAYRHAVEELPETMETLLLLGLMILLTGGAMLFLISGKGIGKTSIGLICVIASSGMLWMAEIPLQWIASAIILEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVASVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRSMPGTRRVMGITAEWLWRTLGRNKKPRLCTREEFTKKVRTNAAMGAVFTEENQWDSAKAAVEDEDFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPTGTVMDIISRKDQRGSGQVGTYGLNTFTNMEAQLIRQMEGEGVLSKADLENPHLPEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLRETACLGKAYAQMWSLMYFHRRDLRLASNAICSAVPVHWVPTSRTTWSIHAHHQWMTTEDMLTVWNRVWIEDNPWMEDKTPVTTWENVPYLGKREDQWCGSLIGLTSRATWAQNIPTAIQQVRSLIGNEEFLDYMPSMKRFRKEEESEGAIW

SEQ ID NO: 4962 - protein, 3290 aa, Artificial Sequence
  derived and/or modified protein sequence (wt) from DENV-3__FJ639766__SS-prME
TSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAVLPEEQDQNYVCKHTYVDRGWGNGCGLFGKGSLVTCAKFQCLEPIEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDVPCKIPFSTEDGQGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSASRAWNVWEVEDYGFGVFTTNIWLKLREVYTQLCDHRLMSAAVKDERAVHADMGYWIESQKNGSWKLEKASLIEVKTCTWPKSHTLWSNGVLESDMIIPKSLAGPISQHNYRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGEVDNFTMGVLCLAILFEEVMRGKFGKKHMIAGVFFTFVLLLSGQITWRDMAHTLIMIGSNASDRMGMGVTYLALIATFKIQPFLALGFFLRKLTSRENLLLGVGLAMATTLQLPEDIEQMANGIALGLMALKLITQFETYQLWTALISLTCSNTIFTLTVAWRTATLILAGVSLLPVCQSSSMRKTDWLPMTVAAMGVPPLPLFIFNLKDTLKRRSWPLNEGVMAVGLVSILASSLLRNDVPMAGPLVAGGLLIACYVITGTSADLTVEKAADVTWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTYNGKRLEPNWASVKKDLISYGGGWRLSAQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKDFAAGRKSIALDLVTEIGRVPTHLAHRTRNALDNLVMLHTSEHGGKAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVASVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRSMPGTRRVMGITAEWLWRTLGRNKKPRLCTREEFTKKVRTNAAMGAVFTEENQWDSAKAAVEDEDFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPTGTVMDIISRKDQRGSGQVGTYGLNTFTNMEAQLIRQMEGEGVLSKADLENPHLPEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLRETACLGKAYAQMWSLMYFHRRDLRLASNAICSAVPVHWVPTSRTTWSIHAHHQWMTTEDMLTVWNRVWIEDNPWMEDKTPVTTWENVPYLGKREDQWCGSLIGLTSRATWAQNIPTAIQQVRSLIGNEEFLDYMPSMKRFRKEEESEGAIW

SEQ ID NO: 4963 - protein, 3290 aa, Artificial Sequence
  derived and/or modified protein sequence (wt) from DENV-3__FJ639767__SS-prME
TSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAVLPEEQDQNYVCKHTYVDRGWGNGCGLFGKGSLVTCAKFQCLEPIEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDVPCKIPFSTEDGQGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSASRAWNVWEVEDYGFGVFTTNIWLKLREVYTQLCDHRLMSAAVKDERAVHADMGYWIESQKNGSWKLEKASLIEVKTCTWPKSHTLWSNGVLESDMIIPKSLAGPISQHNYRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGEVDNFTMGVLCLAILFEEVMRGKFGKKHMIAGVFFTFVLLLSGQITWRDMAHTLIMIGSNASDRMGMGVTYLALIATFKIQPFLALGFFLRKLTSRENLLLGVGLAMATTLQLPEDIEQMANGIALGLMALKLITQFETYQLWTALISLTCSNTIFTLTVAWRTATLILAGVSLLPVCQSSSMRKTDWLPMTVAAMGVPPLPLFIFSLKDTLKRRSWPLNEGVMAVGLVSILASSLLRNDVPMAGPLVAGGLLIACYVITGTSADLTVEKAADVTWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTYNGKRLEPNWASVKKDLISYGGGWRLSAQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKDFAAGRKSIALDLVTEIGRVPSHLAHRTRNALDNLVMLHTSEHGGKAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAAIIAANEMGLLETTKRDLGMSKEPGVVSPISYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVASVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRSMPGTRRVMGITAEWLWRTLGRNKKPRLCTREEFTKKVRTNAAMGAVFTEENQWDSAKAAVEDEDFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPTGTVMDIISRKDQRGSGQVGTYGLNTFTNMEAQLIRQMEGEGVLSKADLENPHLPEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLRETACLGKAYAQMWSLMYFHRRDLRLASNAICSAVPVHWVPTSRTTWSIHAHHQWMTTEDMLTVWNRVWIEDNPWMEDKTPVTTWENVPYLGKREDQWCGSLIGLTSRATWAQNIPTAIQQVRSLIGNEEFLDYMPSMKRFRKEEESEGAIW

SEQ ID NO: 4964 - protein, 3290 aa, Artificial Sequence
  derived and/or modified protein sequence (wt) from DENV-3__FJ639768__SS-prME
TSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAVLPEEQDQNYVCKHTYVDRGWGNGCGLFGKGSLVTCAKFQCLEPIEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDVPCKIPFSTEDGQGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSASRAWNVWEVEDYGFGVFTTNIWLKLREVYTQLCDHRLMSAAVKDERAVHADMGYWIESQKNGSWKLEKASLIEVKTCTWPKSHTLWSNGVLESDMIIPKSLAGPISQHNYRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGEVDNFTMGVLCLAILFEEVMRGKFGKKHMIAGVFFTFVLLLSGQITWRDMAHTLIMIGSNASDRMGMGVTYLALIATFKIQPFLALGFFLRKLTSRENLLLGVGLAMATTLQLPEDIEQMANGIALGLMALKLITQFETYQLWTALISLTCSNTIFTLTVAWRTATLILAGVSLLPVCQSSSMRKTDWLPMTVAAMGVPPLPLFIFSLKDTLKRRSWPLNEGVMAVGLVSILASSLLRNDVPMAGPLVAGGLLIACYVITGTSADLTVEKAADVTWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTYNGKRLEPNWASVKKDLISYGGGWRLNAQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPIPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKDFAAGRKSIALDLVTEIGRVPSHLAHRTRNALDNLVMLHTSEHGGKAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYIAGAGLAFSIMKSVGTGKRGTGSQGETLGEKWKKKLNQLSRKEFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVASVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRSMPGTRRVMGITAEWLWRTLGRNKKPRLCTREEFTKKVRTNAAMGAVFTEENQWDSAKAAVEDEDFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPTGTVMDIISRKDQRGSGQVGTYGLNTFTNMEAQLIRQMEGEGVLSKADLENPHLPEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLRETACLGKAYAQMWSLMYFHRRDLRLASNAICSAVPVHWVPTSRTTWSIHAHHQWMTTEDMLTVWNRVWIEDNPWMEDKTPVTTWENVPYLGKREDQWCGSLIGLTSRATWAQNIPTAIQQVRSLIGNEEFLDYMPSMKRFRKEEESEGAIW

SEQ ID NO: 4965 - protein, 3290 aa, Artificial Sequence
  derived and/or modified protein sequence (wt) from DENV-3__FJ639769__SS-prME
TSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAVLPEEQDQNYVCKHTYVDRGWGNGCGLFGKGSLVTCAKFQCLEPIEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDVPCKIPFSTEDGQGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSASRAWNVWEVEDYGFGVFTTNIWLKLREVYTQLCDHRLMSAAVKDERAVHADMGYWIESQKNGSWKLEKASLIEVKTCTWPKSHTLWSNGVLESDMIIPKSLAGPISQHNYRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGEVDNFTMGVLCLAILFEEVMRGKFGKKHMIAGVFFTFVLLLSGQITWRDMAHTLIMIGSNASDRMGMGVTYLALIATFKIQPFLALGFFLRKLTSRENLLLGVGLAMATTLQLPEDIEQMANGIALGLMALKLITQFETYQLWTALISLTCSNTIFTLTVAWRTATLILAGVSLLPVCQSSSMRKTDWLPMTVAAMGVPPLPLFIFSLKDTLKRRSWPLNEGVMAVGLVSILASSLLRNDVPMAGPLVAGGLLIACYVITGTSADLTVEKAADVTWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTYNGKRLEPNWASVKKDLISYGGGWRLSAQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKDFAAGRKSIALDLVTEIGRVPTHLAHRTRNALDNLVMLHTSEHGGKAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCVVQLLLMRTSWALCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVASVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRSMPGTRRVMGITAEWLWRTLGRNKKPRLCTREEFTKKVRTNAAMGAVFTEENQWDSAKAAVEDEDFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPTGTVMDIISRKDQRGSGQVGTYGLNTFTNMEAQLIRQMEGEGVLSKADLENPHLPEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLRETACLGKAYAQMWSLMYFHRRDLRLASNAICSAVPVHWVPTSRTTWSIHAHHQWMTTEDMLTVWNRVWIEDNPWMEDKTPVTTWENVPYLGKREDQWCGSLIGLTSRATWAQNIPTAIQQVRSLIGNEEFLDYMPSMKRFRKEEESEGAIW

SEQ ID NO: 4966 - protein, 3290 aa, Artificial Sequence
  derived and/or modified protein sequence (wt) from DENV-3__FJ882577__SS-prME
TSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAVLPEEQDQNYVCKHTYVDRGWGNGCGLFGKGSLVTCAKFQCLEPIEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDVPCKIPFSTEDGQGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSASRAWNVWEVEDYGFGVFTTNIWLKLREVYTQLCDHRLMSAAVKDERAVHADMGYWIESQKNGSWKLEKASLIEVKTCTWPKSHTLWSNGVLESDMIIPKSLAGPISQHNYRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGEVDNFTMGVLCLAILFEEVMRGKFGKKHMIAGIFFTFVLLLSGQITWRDMAHTLIMIGSNASDRMGMGVTYLALIATFKIQPFLALGFFLRKLTSRENLLLGVGLAMATTLQLPEDIEQMANGIALGLMALKLITQFETYQLWTALISLTCSNTIFTLTVAWRTATLILAGVSLLPVCQSSSMRKTDWLPMTVAAMGVPPLPLFIFSLKDTLKRRSWPLNEGVMAVGLVSILASSLLRNDVPMAGPLVAGGLLIACYVITGTSADLTVEKAADVTWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTYNGKRLEPNWASVKKDLISYGGGWRLSAQWQKGEEVQVIAVEPGKNPKNFQTMPGTFQTTTGEIGAIALDFKPGTSGSPIINREGKIVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKDFAAGRKSIALDLVTEIGRVPTHLAHRTRNALDNLVMLHTSEHGGKAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVASVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRSMPGTRRVMGITAEWLWRTLGRNKKPRLCTREEFTKKVRTNAAMGAVFTEENQWDSAKAAVEDEDFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPTGTVMDIISRKDQRGSGQVGTYGLNTFTNMEAQLIRQMEGEGVLSKADLENPHLPEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLRETACLGKAYAQMWSLMYFHRRDLRLASNAICSAVPVHWVPTSRTTWSIHAHHQWMTTEDMLTVWNRVWIEDNPWMEDKTPVTTWENVPYLGKREDQWCGSLIGLTSRATWAQNIPTAIQQVRSLIGNEEFLDYMPSMKRFRKEEESEGAIW

SEQ ID NO: 4967 - protein, 3290 aa, Artificial Sequence
  derived and/or modified protein sequence (wt) from DENV-3__FJ850096__SS-prME
TSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAVLPEEQDQNYVCKHTYVDRGWGNGCGLFGKGSLVTCAKFQCLEPIEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDVPCKIPFSTEDGQGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGLLLTWIGLNSKNTSMSFSCIAIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSASRAWNVWEVEDYGFGVFTTNIWLKLREVYTQLCDHRLMSAAVKDERAVHADMGYWIESQKNGSWKLEKASLIEVKTCTWPKSHTLWSNGVLESDMIIPKSLAGPISQHNYRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGEVDNFTMGVLCLAILFEEVMRGKFGKKHMIAGVFFTFVLLLSGQITWRDMAHTLIMIGSNASDRMGMGVTYLALIATFKIQPFLALGFFLRKLTSRENLLLGVGLAMATTLQLPEDIEQMANGIALGLMALKLITQFETYQLWTALISLTCSNTIFTLTVAWRTATLILAGVSLLPVCQSSSMRKTDWLPMTVAAMGVPPLPLFIFSLKDTLKRRSWPLNEGVMAVGLVSILASSLLRNDVPMAGPLVAGGLLIACYVITGTSADLTVEKAADVTWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTYNGKRLEPNWASVKKDLISYGGGWRLSAQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFTGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKDFAAGRKSIALDLVTEIGRVPSHLAHRTRNALDNLVMLHTSEHGGKAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVASVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRSMPGTRRVMGITAEWLWRTLGRNKKPRLCTREEFTKKVRTNAAMGAVFTEENQWDSAKAAVEDEDFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPTGTVMDIISRKDQRGSGQVGTYGLNTFTNMEAQLIRQMEGEGVLSKADLENPHLPEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLRETACLGKAYAQMWSLMYFHRRDLRLASNAICSAVPVHWVPTSRTTWSIHAHHQWMTTEDMLTVWNRVWIEDNPWMEDKTPVTTWENVPYLGKREDQWCGSLIGLTSRATWAQNIPTAIQQVRSLIGNEEFLDYMPSMKRFRKEEESEGAIW

SEQ ID NO: 4968 - protein, 3290 aa, Artificial Sequence
  derived and/or modified protein sequence (wt) from DENV-3__FJ882578__SS-prME
TSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAVLPEEQDQNYVCKHTYVDRGWGNGCGLFGKGSLVTCAKFQCLEPIEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDVPCKIPFSTEDGQGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDTIGVLEQGKRILTPQPMELKYSWKTWGKAKIVTAETQNSSFIIDGPNTPECPSASRAWNVWEVEDYGFGVFTTNIWLKLREVYTQLCDHRLMSAAVKDERAVHADMGYWIESQKNGSWKLEKASLIEVKTCTWPKSHTLWSNGVLESDMIIPKSLAGPISQHNYRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGEVDNFTMGVLCLAILFEEVMRGKFGKKHMIAGVFFTFVLLLSGQITWRDMAHTLIMIGSNASDRMGMGVTYLALIATFKIQPFLALGFFLRKLTSRENLLLGVGLAMATTLQLPEDIEQMANGIALGLMALKLITQFETYQLWTALISLTCSNTIFTLTVAWRTATLILAGVSLLPVCQSSSMRKTDWLPMTVAAMGVPPLPLFIFSLKDTLKRRSWPLNEGVMAVGLVSILASSLLRNDVPMAGPLVAGGLLIACYVITGTSADLTVEKAADVTWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTYNGKRLEPNWASVKKDLISYGGGWRLSAQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKDFAAGRKSIALDLVTEIGRVPTHLAHRTRNALDNLVMLHTSEHGGKAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVASVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRSMPGTRRVMGITAEWLWRTLGRNKKPRLCTREEFTKKVRTNAAMGAVFTEENQWDSAKAAVEDEDFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPTGTVMDIISRKDQRGSGQVGTYGLNTFTNMEAQLIRQMEGEGVLSKADLENPHLPEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLRETACLGKAYAQMWSLMYFHRRDLRLASNAICSAVPVHWVPTSRTTWSIHAHHQWMTTEDMLTVWNRVWIEDNPWMEDKTPVTTWENVPYLGKREDQWCGSLIGLTSRATWAQNIPTAIQQVRSLIGNEEFLDYMPSMKRFRKEEESEGAIW

SEQ ID NO: 4969 - protein, 3290 aa, Artificial Sequence
  derived and/or modified protein sequence (wt) from DENV-3__FJ639770__SS-prME
TSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAVLPEEQDQNYVCKHTYVDRGWGNGCGLFGKGSLVTCAKFQCLEPIEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDVPCKIPFSTEDGQGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDVIGVLEQGKRTLTLQPMELKYSWKTWGKAKIVTAETQNSSFIIDGPNTPECPSASRAWNVWEVEDYGFGVFTTNIWLKLREVYTQLCDHRLMSAAVKDERAVHADMGYWIESQKNGSWKLEKASLIEVKTCTWPKSHTLWSNGVLESDMIIPKSLAGPISQHNYRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGEVDNFTMGVLCLAILFEEVMRGKFGKKHMIAGVFFTFVLLLSGQITWRDMAHTLIMIGSNASDRMGMGVTYLALIATFKIQPFLALGFFLRKLTSRENLLLGVGLAMATTLQLPEDIEQMANGIALGLMALKLITQFETYQLWTALISLTCSNTIFTLTVAWRTATLILAGVSLLPVCQSSSMRKTDWLPMTVAAMGVPPLPLFIFSLKDTLKRRSWPLNEGVMAVGLVSILASSLLRNDVPMAGPLVAGGLLIACYVITGTSADLTVEKAADVTWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTYNGKRLEPNWASVKKDLISYGGGWRLSAQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKDFAAGRKSIALDLVTEIGRVPSHLAHRTRNALDNLVMLHTSEHGGKAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVVEHLERLQRKHGGMLVRNPLSRNSTHEMYWISNGTGNIVASVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRSMPGTRRVMGITAEWLWRTLGRNKKPRLCTREEFTKKVRTNAAMGAVFTEENQWDSAKAAVEDEDFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPTGTVMDIISRKDQRGSGQVGTYGLNTFTNMEAQLIRQMEGEGVLSKADLENPRLPEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLRETACLGKAYAQMWSLMYFHRRDLRLASNAICSAVPVHWVPTSRTTWSIHAHHQWMTTEDMLTVWNRVWIEDNPWMEDKTPVTTWENVPYLGKREDQWCGSLIGLTSRATWAQNIPTAIQQVRSLIGNEEFLDYMPSMKRFRKEEESEGAIW

SEQ ID NO: 4970 - protein, 3290 aa, Artificial Sequence
  derived and/or modified protein sequence (wt) from DENV-3__FJ639771__SS-prME
TSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAVLPEEQDQNYVCKHTYVDRGWGNGCGLFGKGSLVTCAKFQCLEPIEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDVPCKIPFSTEDGQGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQADMGCVINWKGKELKCGSGIFVTNEVHTWTEQYKFQADSPKRLATAIAGAWENGVCGIRSTTRMENLLWKQIANELNYILRENNIKLTVVVGDVIGVLEQGKRTLTPQPMELKYSWKTWGKAKIVTAETQNSSFIIDGPNTPECPSASRAWNVWEVEDYGFGVFTTNIWLKLREVYTQLCDHRLMSAAVKDERAVHADMGYWIESQKNGSWKLEKASLIEVKTCTWPKSHTLWSNGVLESDMIIPKSLAGPISQHNYRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGEVDNFTMGVLCLAILFEEVMRGKFGKKHMIAGVFFTFVLLLSGQITWRDMAHTLIMIGSNASDRMGMGVTYLALIATFKIQPFLALGFFLRKLTSRENLLLGVGLAMATTLQLPEDIEQMANGIALGLMALKLITQFETYQLWTALISLTCSNTIFTLTVAWRTATLILAGVSLLPVCQSSSMRKTDWLPMTVAAMGVPPLPLFIFSLKDTLKRRSWPLNEGVMAVGLVSILASSLLRNDVPMAGPLVAGGLLIACYVITGTSADLTVEKAADVTWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTYNGKRLEPNWASVKKDLISYGGGWRLSAQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKDFAAGRKSIALDLVTEIGRVPSHLAHRTRNALDNLVMLHTSEHGGKAYRHAVEELPETMETLLLLGLMILLTGGAMLFLISGKGIGKTSIGLICVIASSGLLWMAEIPLQWIASAIVLEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVVEHLERLQRKHGGMLVRNPLSRNSTHEMYWISNGTGNIVASVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRSMPGTRRVMGITAEWLWRTLGRNKKPRLCTREEFTKKVRTNAAMGAVFTEENQWDSAKAAVEDEDFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPTGTVMDIISRKDQRGSGQVGTYGLNTFTNMEAQLIRQMEGEGVLSKADLENPRLPEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLRETACLGKAYAQMWSLMYFHRRDLRLASNAICSAVPVHWVPTSRTTWSIHAHHQWMTTEDMLTVWNRVWIEDNPWMEDKTPVTTWENVPYLGKREDQWCGSLIGLTSRATWAQNIPTAIQQVRSLIGNEEFLDYMPSMKRFRKEEESEGAIW

SEQ ID NO: 4971 - protein, 3290 aa, Artificial Sequence
  derived and/or modified protein sequence (wt) from DENV-3__FJ639772__SS-prME
TSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAVLPEEQDQNYVCKHTYVDRGWGNGCGLFGKGSLVTCAKFQCLEPIEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDAPCKIPFSTEDGQGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSASRAWNVWEVEDYGFGVFTTNIWLKLREVYTQLCDHRLMSAAVKDERAVHADMGYWIESQKNGSWKLEKASLIEVKTCTWPKSHTLWSNGVLESDMIIPKSLAGPISQHNYRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGEVDNFTMGVLCLAILFEEVMRGKFGKKHMIAGVFFTFVLLLSGQITWRDMAHTLIMIGSNASDRMGMGVTYLALIATFKIQPFLALGFFLRKLTSRENLLLGVGLAMATTLQLPEDIEQMANGIALGLMALKLITQFETYQLWTALISLTCSNTIFTLTVAWRTATLILAGVSLLPVCQSSSMRKTDWIPMTVAAMGVPPLPLFIFSLKDTLKRRSWPLNEGVMAVGLVSILASSLLRNDVPMAGPLVAGGLLIACYVITGTSADLTVEKAADVTWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTYNGKRLEPNWASVKKDLISYGGGWRLSAQWQKGEEVQVIAVEPGKNPKNFQTMPGTFQTTTGEIGAIALDFKPGTSGSPIINREGKIVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTSATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKDFAAGRKSIALDLVTEIGRVPTHLAHRTRNALDNLVMLHTSEHGGKAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVASVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRSMPGTRRVMGITAEWLWRTLGRNKKPRLCTREEFTKKVRTNAAMGAVFTEENQWDSAKAAVEDEDFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPTGTVMDIISRKDQRGSGQVGTYGLNTFTNMEAQLIRQMEGEGVLSKADLENPHLPEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLRETACLGKAYAQMWSLMYFHRRDLRLASNAICSAVPVHWVPTSRTTWSIHAHHQWMTTEDMLTVWNRVWIEDNPWMEDKTPVTTWENVPYLGKREDQWCGSLIGLTSRATWAQNIPTAIQQVRSLIGNEEFLDYMPSMKRFRKEEESEGAIW

SEQ ID NO: 4972 - protein, 3290 aa, Artificial Sequence
  derived and/or modified protein sequence (wt) from DENV-3__FJ639774__SS-prME
TSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAVLPEEQDQNYVCKHTYVDRGWGNGCGLFGKGSLVTCAKFQCLEPIEGKVVQYENLKYTVIITVHTGDQHQVGNETQGVTAEITPQASTTEAILPEYGTLGLECSPRTGLDFNEMILLTMKNKAWMVHRQWFFDLPLPWTSGTTTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDVPCKIPFSTEDGQGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPNASRAWNVWEVEDYGFGVFTTNIWLKLREVYTQLCDHRLMSAAVKDERAVHADMGYWIESQKNGSWKLEKASLIEVKTCTWPKSHTLWSNGVLESDMIIPKSLAGPISQHNYRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGEVDNFTMGVLCLAILFEEVMRGKFGKKHMIAGVFFTFVLLLSGQITWRDMAHTLIMIGSNASDRMGMGVTYLALIATFKIQPFLALGFFLRKLTSRENLLLGVGLAMATTLQLPEDIEQMANGIALGLMALKLITQFETYQLWTALISLTCSNTIFTLTVAWRTATLILAGVSLLPVCQSSSMRKTDWLPMTVAAMGVPPLPLFIFSLKDTLKRRSWPLNEGVMAVGLVSILASSLLRNDVPMAGPLVAGGLLIACYVITGTSADLTVEKAADVTWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTYNGKRLEPNWASVKKDLISYGGGWRLSAQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGERKKLRPRWLDARTYSDPLALKEFKDFAAGRKSIALDLVTEIGRVPTHLAHRTRNALDNLVMLHTSEHGGKAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPAVIEHLERLQRKHGGMLVRNPLSRNSTHEMYWISNGTGNIVASVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRSMPGTRRVMGITAEWLWRTLGRNKKPRLCTREEFTKKVRTNAAMGAVFTEENQWDSAKAAVEDEDFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPTGTVMDIISRKDQRGSGQVGTYGLNTFTNMEAQLIRQMEGEGVLSKADLENPHLPEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLRETACLGKAYAQMWSLMYFHRRDLRLASNAICSAVPVHWVPTSRTTWSIHAHHQWMTTEDMLTVWNRVWIEDNPWMEDKTPVTTWENVPYLGKREDQWCGSLIGLTSRATWAQNIPTAIQQVRSLIGNEEFLDYMPSMKRFRKEEESEGAIW

SEQ ID NO: 4973 - protein, 3290 aa, Artificial Sequence
  derived and/or modified protein sequence (wt) from DENV-3__FJ639775__SS-prME
TSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAVLPEEQDQNYVCKHTYVDRGWGNGCGLFGKGSLVTCAKFQCLEPIEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDVPCKIPFSTEDGQGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSASRAWNVWEVEDYGFGVFTTNIWLKLREVYTQLCDHRLMSAAVKDERAVHADMGYWIESQKNGSWKLEKASLIEVKTCTWPKSHTLWSNGVLESDMIIPKSLAGPISQHNYRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGEVDNFTMGVLCLAILFEEVMRGKFGKKHMIAGVFFTFVLLLSGQITWRDMAHTLIMIGSNASDRMGMGVTYLALIATFKIQPFLALGFFLRKLTSRENLLLGVGLAMATTLQLPEDIEQMANGIALGLMALKLITQFETYQLWTALISLTCSNTIFTLTVAWRTATLILAGVSLLPVCQSSSMRKTDWLPMTVAAMGVPPLPLFIFSLKDTLKRRSWPLNEGVMAVGLVSILASSLLRNDVPMAGPLVAGGLLIACYVITGTSADLTVEKAADVTWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTYNGKRLEPNWASVKKDLISYGGGWRLSAQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKDFAAGRKSIALDLVTEIGRVPSHLAHRTRNALDNLVMLHTSEHGGKAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVASVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRSMPGTRRAMGITAEWLWRTLGRNKKPRLCTREEFTKKVRTNAAMGAVFTEENQWDSAKAAVEDEDFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPTGTVMDIISRKDQRGSGQVGTYGLNTFTNMEAQLIRQMEGEGVLSKADLENPHLPEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLRETACLGKAYAQMWSLMYFHRRDLRLASNAICSAVPVHWVPTSRTTWSIHAHHQWMTTEDMLTVWNRVWIEDNPWMEDKTPVTTWENVPYLGKREDQWCGSLIGLTSRATWAQNIPTAIQQVRSLIGNEEFLDYMPSMKRFRKEEESEGAIW

SEQ ID NO: 4974 - protein, 3290 aa, Artificial Sequence
  derived and/or modified protein sequence (wt) from DENV-3__FJ639777__SS-prME
TSLCLMMTLPAALAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAVLPEEQDQNYVCKHTYVDRGWGNGCGLFGKGSLVTCAKFQCLEPIEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDVPCKIPFSTEDGQGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVAAETQNSSFIIDGPNTPECPSASRAWNVWEVEDYGFGVFTTNIWLKLREVYTQLCDHRLMSAAVKDERAVHADMGYWIESQKNGSWKLEKASLIEVKTCTWPKSHTLWSNGVLESDMIIPKSLAGPISQHNYRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGEVDNFTMGVLCLAILFEEVMRGKLGKKHMIAGVFFTFVLLLSGQITWRDMAHTLIMIGSNASDRMGMGVTYLALIATFKIQPFLALGFFLRKLTSRENLLLGVGLAMATTLQLPEDIEQMANGIALGLMALKLITQFETYQLWTALISLTCSNTIFTLTVAWRTATLILAGVSLLPVCQSSSMRKTDWLPMTVAAMGVPPLPLFIFSLKDTLKRRSWPLNEGVMAVGLVSILASSLLRNDVPMAGPLVAGGLLIACYVITGTSADLTVEKAADVTWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTYNGKRLEPNWASVKKDLISYGGGWRLNAQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPIPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKDFAAGRKSIALDLVTEIGRVPSHLAHRTRNALDNLVMLHTSEHGGKAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYIAGAGLAFSIMKSVGTGKRGTGSQGETLGEKWKKKLNQLSRKEFDLYKKSGITEVDRTEAKEGLKRGEITHHAVSRGSAKLQWFVERNMVTPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRSPLSRNSTHEMYWISNGTGNIVASVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRSMPGTRRVMGITAEWLWRTLGRNKKPRLCTREEFTKKVRTNAAMGAVFTEENQWDSAKAAVEDEDFWKLVDRERELHRLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPTGTVMDIISRKDQRGSGQVGTYGLNTFTNMEAQLIRQMEGEGVLSKADLENPHLPEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLRETACLGKAYAQMWSLMYFHRRDLRLASNAICSAVPVHWVPTSRTTWSIHAHHQWMTTEDMLTVWNRVWIEDNPWMEDKTPVTTWENVPYLGKREDQWCGSLIGLTSRATWAQNIPTAIQQVRSLIGNEEFLDYMPSMKRFRKEEESEGAIW

SEQ ID NO: 4975 - protein, 3290 aa, Artificial Sequence
  derived and/or modified protein sequence (wt) from DENV-3__FJ639778__SS-prME
TSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGRITNITTDSRCPTQGEAVLPEEQDQNYVCKHTYVDRGWGNGCGLFGKGSLVTCAKFQCLEPIEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDVPCKIPFSTEDGQGKAHNGRLITANPVVTKKEEPVNIEAEPPFGESNMVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSASRAWNVWEVEDYGFGVFTTNIWLKLREVYTQLCDHRLMSAAVKDERAVHADMGYWIESQKNGSWKLEKASLIEVKTCTWPKSHTLWSNGVLESDMIIPKSLAGPISQHNYRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGEVDNFTMGVLCLAILFEEVMRGKFGKKHMIAGVFFTFVLLLSGQITWRDMAHTLIMIGSNASDRMGMGVTYLALIATFKIQPFLALGFFLRKLTSRENLLLGVGLAMATTLQLPEDIEQMANGIALGLMALKLITQFETYQLWTALISLTCSNTIFTLTVAWRTATLILAGVSLLPVCQSSSMRKTDWLPMTVAAMGVPPLPLFIFSLKDTLKRRSWPLNEGVMAVGLVSILASSLLKNDVPMAGPLVAGGLLIACYVITGTSADLTVEKAADVTWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTYNGKRLEPNWASVKKDLISYGGGWRLSAQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKDFAAGRKSIALDLVTEIGRVPTHLAHRTRNALDNLVMLHTSEHGGKAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLRRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVASVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRSMPGTRRVMGITAEWLWRTLGRNKKPRLCTREEFTKKVRTNAAMGAVFTEENQWDSAKAAVEDEDFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPTGTVMDIISRKDQRGSGQVGTYGLNTFTNMEAQLIRQMEGEGVLSKADLENPHLPEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLRETACLGKAYAQMWSLMYFHRRDLRLASNAICSAVPVHWVPTSRTTWSIHAHHQWMTTEDMLTVWNRVWIEDNPWMEDKTPVTTWENVPYLGKREDQWCGSLIGLTSRATWAQNIPTAIQQVRSLIGNEEFLDYMPSMKRFRKEEESEGAIW

SEQ ID NO: 4976 - protein, 3290 aa, Artificial Sequence
  derived and/or modified protein sequence (wt) from DENV-3__FJ639779__SS-prME
TSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAVLPEEQDQNYVCKHTYVDRGWGNGCGLFGKGSLVTCAKFQCLEPIEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDVPCKIPFSTEDGQRKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSASRAWNVWEVEDYGFGVFTTNIWLKLREVYTQLCDHRLMSAAVKDERAVHADMGYWIESQKNGSWKLEKASLIEVKTCTWPKSHTLWSNGVLESDMIIPKSLAGPISQHNYRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGEVDNFTMGVLCLAILFEEVMRGKFGKKHMIAGVFFTFVLLLSGQITWRDMAHTLIMIGSNASDRMGMGVTYLALIATFKIQPFLALGFFLRKLTSRENLLLGVGLAMATTLQLPEDFEQMANGIALGLMALKLITQFETYQLWTALISLTCSNTIFTLTVAWRTATLILAGVSLLPVCQSSSMRKTDWLPMTVAAMGVPPLPLFIFSLKDTLKRRSWPLNEGVMAVGLVSILASSLLRNDVPMAGPLVAGGLLIACYVITGTSADLTVEKAADVTWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTYNGKRLEPNWASVKKDLISYGGGWRLSAQWQKGEEVQVIAVEPGKNPKNFQTMPGTFQTTTGEIGAIALDFKPGTSGSPIINREGKVVGLYGNGVVTKNGGYVSGIAQTNAEPDGPAPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKDFAAGRKSIALDLVTEIGRVPTHLAHRTRNALDNLVMLHTSEHGGKAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVASVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRSMPGTRRVMGITAEWLWRTLGRNKKPRLCTREEFTKKVRTNAAMGAVFTEENQWDSAKAAVEDEDFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPTGTVMDIISRKDQRGSGQVGTYGLNTFTNMEAQLIRQMEGEGVLSKADLENPHLPEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLRETACLGKAYAQMWSLMYFHRRDLRLASNAICSAVPVHWVPTSRTTWSIHAHHQWMTTEDMLTVWNRVWIEDNPWMEDKTPVTTWENVPYLGKREDQWCGSLIGLTSRATWAQNIPTAIQQVRSLIGNEEFLDYMPAMKRFRKEEESEGAIW

SEQ ID NO: 4977 - protein, 3290 aa, Artificial Sequence
  derived and/or modified protein sequence (wt) from DENV-3__FJ639780__SS-prME
TSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAVLPEEQDQNYVCKHTYVDRGWGNGCGLFGKGSLVTCAKFQCLEPIEGKVVQYENLKYTVIITVHTGDQHQVGNETQGVTAEITPQASTTEAILPEYGTLGLECSPRTGLDFNEMILLTMKNKAWMVHRQWFFDLPLPWTSGTTTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDVPCKIPFSTEDGQGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPNASRAWNVWEVEDYGFGVFTTNIWLKLREVYTQLCDHRLMSAAVKDERAVHADMGYWIESQKNGSWKLEKASLIEVKTCTWPKSHTLWSNGVLESDMIIPKSLAGPISQHNYRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGEVDNFTMGVLCLAILFEEVMRGKFGKKHMIAGVFFTFVLLLSGQITWRDMAHTLIMIGSNASDRMGMGVTYLALIATFKIQPFLALGFFLRKLTSRENLLLGVGLAMATTLQLPEDIEQMANGIALGLMALKLITQFETYQLWTALISLTCSNTIFTLTVAWRTATLILAGVSLLPVCQSSSMRKTDWLPMTVAAMGIPPLPLFIFSLKDTLKRRSWPLNEGVMAVGLVSILASSLLRNDVPMAGPLVAGGLLIACYVITGTSADLTVEKAADVTWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTYNGKRLEPNWASVKKDLISYGGGWRLSAQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGERKKLRPRWLDARTYSDPLALKEFKDFAAGRKSIALDLVTEIGRVPTHLAHRTRNALDNLVMLHTSEHGGKAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPAVIEHLERLQRKHGGMLVRNPLSRNSTHEMYWISNGTGNIVASVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRSMPGTRRVMGITAEWLWRTLGRNKKPRLCTREEFTKKVRTNAAMGAVFTEENQWDSAKAAVEDEDFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPTGTVMDIISRKDQRGSGQVGTYGLNTFTNMEAQLIRQMEGEGVLSKADLENPHLPEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLRETACLGKAYAQMWSLMYFHRRDLRLASNAICSAVPVHWVPTSRTTWSIHAHHQWMTTEDMLTVWNRVWIEDNPWMEDKTPVTTWENVPYLGKREDQWCGSLIGLTSRATWAQNIPTAIQQVRSLIGNEEFLDYMPSMKRFRKEEESEGAIW

SEQ ID NO: 4978 - protein, 3290 aa, Artificial Sequence
  derived and/or modified protein sequence (wt) from DENV-3__FJ639781__SS-prME
TSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAQYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAVLPEEQDQNYVCKHTYVDRGWGNGCGLFGKGSLVTCAKFQCLEPIEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDVPCKIPFSTEDGQGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNISMSFSCIAIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDTIGVLEQGKRTLTPQPMELKYSWKTWGKAKIVTAETQNSSFIIDGPNTPECPSASRAWNVWEVEDYGFGVFTTNIWLKLREVYTQLCDHRLMSAAVKDERAVHADMGYWIESQKNGSWKLEKASLIEVKTCTWPKSHTLWSNGVLESDMIIPKSLAGPISQHNYRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGEVDNFTMGVLCLAILFEEVMRGKFGKKHMIAGVFFTFALLLSGQITWRDMAHTLIMIGSNASDRMGMGVTYLALIATFKIQPFLALGFFLRKLTSRENLLLGVGLAMATTLQLPEDIEQMANGIALGLMALKLITQFETYQLWTALISLTCSNTIFTLTVAWRTATLILAGVSLLPVCQSSSMRKTDWLPMTVAAMGVPPLPLFIFSLKDTLKRRSWPLNEGVMAVGLVSILASSLLRNDVPMAGPLVAGGLLIACYVITGTSADLTVEKAADVTWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTYNGKRLEPNWASVKKDLISYGGGWRLSAQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKDFAAGRKSIALDLVTEIGRVPTHLAHRTRNALDNLVMLHTSEHGGKAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAATIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVASVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRSMPGTRRVMGITAEWLWRTLGRNKKPRLCTREEFTKKVRTNAAMGAVFTEENQWDSAKAAVEDEDFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPTGTVMDIISRKDQRGSGQVGTYGLNTFTNMEAQLIRQMEGEGVLSKADLENPHLPEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLRETACLGKAYAQMWSLMYFHRRDLRLASNAICSAVPVHWVPTSRTTWSIHAHHQWMTTEDMLTVWNRVWIEDNPWMEDKTPVTTWENVPYLGKREDQWCGSLIGLTSRATWAQNIPTAIQQVRSLIGNEEFLDYMPSMKRFRKEEESEGAIW

SEQ ID NO: 4979 - protein, 3290 aa, Artificial Sequence
  derived and/or modified protein sequence (wt) from DENV-3__FJ639782__SS-prME
TSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAVLPEEQDQNYVCKHTYVDRGWGNGCGLFGKGSLVTCAKFQCLEPIEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDVPCKIPFSTEDGQGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSASRAWNVWEVEDYGFGVFTTNIWLKLREVYTQLCDHRLMSAAVKDERAVHADMGYWIESQKNGSWKLEKASLIEVKTCTWPKSHTLWSNGVLESDMIIPKSLAGPISQHNYRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGEVDNFTMGVLCLAILFEEVMRGKFGKKHMIAGVFFTFVLLLSGQITWRDMAHTLIMIGSNASDRMGMGVTYLALIATFKIQPFLALGFFLRKLTSRENLLLGVGLAMATTLQLPEDIEQMANGIALGLMALKLITQFETYQLWTALISLTCSNTIFTLTVAWRTATLILAGVSLLPVCQSSSMRKTDWLPMTVAAMGVPPLPLFIFSLKDTLKRRSWPLNEGVMAVGLVSILASSLLRNDVPMAGPLVAGGLLIACYVITGTSADLTVEKAADVTWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTYNGKRLEPNWASVKKDLISYGGGWRLSAQWQKGEEVQVIAVEPGKNPKNFQTMPGTFQTTTGEIGAIALDFKPGTSGSPIINREGKIVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKDFAAGRKSIALDLVTEIGRVPTHLAHRTRNALDNLVMLHTSEHGGKAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAATIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVASVNMVSRLLLNRFTMTYRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRSMPGTRRVMGITAEWLWRTLGRNKKPRLCTREEFTKKVRTNAAMGAVFTEENQWDSAKAAVEDEDFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPTGTVMDIISRKDQRGSGQVGTYGLNTFTNMEAQLIRQMEGEGVLSKADLENPHLPEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLRETACLGKAYAQMWSLMYFHRRDLRLASNAICSAVPVHWVPTSRTTWSIHAHHQWMTTEDMLTVWNRVWIEDNPWMEDKTPVTTWENVPYLGKREDQWCGSLIGLTSRATWAQNIPTAIQQVRSLIGNEEFLDYMPSMKRFRKEEESEGAIW

SEQ ID NO: 4980 - protein, 3290 aa, Artificial Sequence
  derived and/or modified protein sequence (wt) from DENV-3__FJ639785__SS-prME
TSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAVLPEEQDQNYVCKHTYVDRGWGNGCGLFGKGSLVTCAKFQCLEPIEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDVPCKIPFSTEDGQGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDTIGVLEQGKRTLTPQPMELKYSWKTWGKAKIVTAETQNSSFIIDGPNTPECPSASRAWNVWEVEDYGFGVFTTNIWLKLREVYTQLCDHRLMSAAVKDERAVHADMGYWIESQKNGSWKLEKASLIEVKTCTWPKSHTLWSNGVLESDMIIPKSLAGPISQHNYRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGEVDNFTMGVLCLAILFEEVMRGKFGKKHMIAGVFFTFVLLLSGQITWRDMAHTLIMIGSNASDRMGMGVTYLALIATFKIQPFLALGFFLRKLTSRENLLLGVGLAMATTLQLPEDIEQMANGIALGLMALKLITQFETYQLWTALISLTCSNTIFTLTVAWRTATLILAGVSLLPVCQSSSMRKTDWLPMTVAAMGVPPLPLFIFSLKDTLKRRSWPLNEGVMAVGLVSILASSLLRNDVPMAGPLVAGGLLIACYVITGTSADLTVEKAADVTWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTYNGKRLEPNWASVKKDLISYGGGWRLSAQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKDFAAGRKSIALDLVTEIGRVPTHLAHRTRNALDNLVMLHTSEHGGKAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAATIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVASVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRSMPGTRRVMGITAEWLWRTLGRNKKPRLCTREEFTKKVRTNAAMGAVFTEENQWDSAKAAVEDEDFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPTGTVMDIISRKDQRGSGQVGTYGLNTFTNMEAQLIRQMEGEGVLSKADLENPHLPEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLRETACLGKAYAQMWSLMYFHRRDLRLASNAICSAVPVHWVPTSRTTWSIHAHHQWMTTEDMLTVWNRVWIEDNPWMEDKTPVTTWENVPYLGKREDQWCGSLIGLTSRATWAQNIPTAIQQVRSLIGNEEFLDYMPSMKRFRKEEESEGAIW

SEQ ID NO: 4981 - protein, 3290 aa, Artificial Sequence
  derived and/or modified protein sequence (wt) from DENV-3__FJ639786__SS-prME
TSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAVLPEEQDQNYVCKHTYVDRGWGNGCGLFGKGSLVTCAKFQCLEPIEGKVVQYENLKYTVIITVHTGDQHQVGNETQGVTAEITPQASTTEAILPEYGTLGLECSPRTGLDFNEMILLTMKNKAWMVHRQWFFDLPLPWASGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDVPCKIPFSTEDGQGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSASRAWNVWEVEDYGFGVFTTNIWLKLREVYTQLCDHRLMSAAVKDERAVHADMGYWIESQKNGSWKLEKASLIEVKTCTWPKSHTLWSNGVLESDMIIPKSLAGPISQHNYRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGEVDNFTMGVLCLAILFEEVMRGKFGKKHMIAGVFFTFVLLLSGQITWRDMAHTLIMIGSNASDRMGMGVTYLALIATFKIQPFLALGFFLRKLTSRENLLLGVGLAMATTLQLPEDIEQMANGIALGLMALKLITQFETYQLWTALISLTCSNTIFTLTVAWRTATLILAGVSLLPVCQSSSMRKTDWLPMTVAAMGVPPLPLFIFSLKDTLKRRSWPLNEGVMAVGLVSILASSLLRNDVPMAGPLVAGGLLIACYVITGTSADLTVEKAADVTWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTYNGKRLEPNWASVKKDLISYGGGWRLSAQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKTDRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKDFAAGRKSIALDLVTEIGRVPTHLAHRTRNALDNLVMLHTSEHGGKAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRREFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVASVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRPMPGTRRVMGITAEWLWRTLGRNKKPRLCTREEFTKKVRTNAAMGAVFTEENQWDSAKAAVEDEDFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPTGTVMDIISRKDQRGSGQVGTYGLNTFTNMEAQLIRQMEGEGVLSKADLENPHLPEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLRETACLGKAYAQMWSLMYFHRRDLRLASNAICSAVPVHWVPTSRTTWSIHAHHQWMTTEDMLTVWNRVWIEDNPWMEDKTPVTTWENVPYLGKREDQWCGSLIGLTSRATWAQNISTAIQQVRSLIGNEEFLDYMPSMKRFRKEEESEGAIW

SEQ ID NO: 4982 - protein, 3290 aa, Artificial Sequence
  derived and/or modified protein sequence (wt) from DENV-3__FJ639787__SS-prME
TSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWLSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAVLPEEQDQNYVCKHTYVDRGWGNGCGLFGKGSLVTCAKFQCLEPIEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDVPCKIPFSTEDGQGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDTIGVLEQGKRTLTPQPMELKYSWKTWGKAKIVTAETQNSSFIIDGPNTPECPSASRAWNVWEVEDYGFGVFTTNIWLKLREVYTQLCDHRLMSAAVKDERAVHADMGYWIESQKNGSWKLEKASLIEVKTCTWPKSHTLWSNGVLESDMIIPKSLAGPISQHNYRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGEVDNFTMGVLCLAILFEEVMRGKFGKKHMIAGVFFTFVLLLSGQITWRDMAHTLIMIGSNASDRMGMGVTYLALIATFKIQPFLALGFFLRKLTSRENLLLGVGLAMATTLQLPEDIEQMANGIALGLMALKLITQFETYQLWTALISLTCSNTIFTLTVAWRTATLILAGVSLLPVCQSSSMRKTDWLPMTVAAMGVPPLPLFIFSLKDTLKRRSWPLNEGVMAVGLVSILASSLLRNDVPMAGPLVAGGLLIACYVITGTSADLTVEKAADVTWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTYNGKRLEPNWASVKKDLISYGGGWRLSAQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKDFAAGRKSIALDLVTEIGRVPTHLAHRTRNALDNLVMLHTSEHGGKAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAATIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVASVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRSMPGTRRVMGITAEWLWRTLGRNKKPRLCTREEFTKKVRTNAAMGAVFTEENQWDSAKAAVEDEDFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPTGTVMDIISRKDQRGSGQVGTYGLNTFTNMEAQLIRQMEGEGVLSKADLENPHLPEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLRETACLGKAYAQMWSLMYFHRRDLRLASNAICSAVPVHWVPTSRTTWSIHAHHQWMTTEDMLTVWNRVWIEDNPWMEDKTPVTTWENVPYLGKREDQWCGSLIGLTSRATWAQNIPTAIQQVRSLIGNEEFLDYMPSMKRFRKEEESEGAIW

SEQ ID NO: 4983 - protein, 3290 aa, Artificial Sequence
  derived and/or modified protein sequence (wt) from DENV-3__FJ639790__SS-prME
TSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAVLPEEQDQNYVCKHTYVDRGWGNGCGLFGKGSLVTCAKFQCLEPIEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDVPCKIPFSTEDGQGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSASRAWNVWEVEDYGFGVFTTNIWLKLREVYTQLCDHRLMSAAVKDERAVHADMGYWIESQKNGSWKLEKASLIEVKTCTWPKSHTLWSNGVLESDMIIPKSLAGPISQHNYRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGEVDNFTMGVLCLAILFEEVMRGKFGKKHMIAGVFLTFVLLLSGQITWRDMAHTLIMIGSNASDRMGMGVTYLALIATFKIQPFLALGFFLRKLTSRENLLLGVGLAMATTLQLPEDIEQMANGIALGLMALKLITQFETYQLWTALISLTCSNTIFTLTVAWRTATLILAGVSLLPVCQSSSMRKTDWLPMTVAAMGVPPLPLFIFNLKDTLKRRSWPLNEGVMAVGLVSILASSLLRNDVPMAGPLVAGGLLIACYVITGTSADLTVEKAADVTWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTYNGKRLEPNWASVKKDLISYGGGWRLSAQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKDFAAGRKSIALDLVTEIGRVPTHLAHRTRNALDNLVMLHTSEHGGKAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVASVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRSMPGTRRVMGITAEWLWRTLGRNKKPRLCTREEFTKKVRTNAAMGAVFTEENQWDSAKAAVEDEDFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPAGTVMDIISRKDQRGSGQVGTYGLNTFTNMEAQLIRQMEGEGVLSKADLENPHLPEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLRETACLGKAYAQMWSLMYFHRRDLRLASNAICSAVPVHWVPTSRTTWSIHAHHQWMTTEDMLTVWNRVWIEDNPWMEDKTPVTTWENVPYLGKREDQWCGSLIGLTSRATWAQNIPTAIQQVRSLIGNEEFLDYMPSMKRFRKEEESEGAIW

SEQ ID NO: 4984 - protein, 3290 aa, Artificial Sequence
  derived and/or modified protein sequence (wt) from DENV-3__FJ639791__SS-prME
TSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAVLPEEQDQNYVCKHTYVDRGWGNGCGLFGKGSLVTCAKFQCLEPVEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDVPCKIPFSTEDGQGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSASRAWNVWEVEDYGFGVFTTNIWLKLREVYTQLCDHRLMSAAVKDERAVHADMGYWIESQKNGSWKLEKASLIEVKTCTWPKSHTLWSNGVLESDMIIPKSLAGPISQHNYRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGEVDNFTMGVLCLAILFEEVMRGKFGKKHMIAGVFFTFVLLLSGQITWRDMAHTLIMIGSNASDRMGMGVTYLALIATFKIQPFLALGFFLRKLTSRENLLLGVGLAMATTLQLPEDIEQMANGIALGLMALKLITQFEIYQLWTALISLTCSNTIFTLTVAWRTATLILAGVSLLPVCQSSSMRKTDWLPMTVAAMGVPPLPLFIFNLKDTLKRRSWPLNEGVMAVGLVSILASSLLRNDVPMAGPLVAGGLLIACYVITGTSADLTVEKAADVTWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTYNGKRLEPNWASVKKDLISYGGGWRLSAQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKDFAAGRKSIALDLVTEIGRVPTHLAHRTRNALDNLVMLHTSEHGGKAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLISGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGSGNIVASVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRSMPGTRRVMGITAEWLWRTLGRNKKPRLCTREEFTKKVRTNAAMGAVFTEENQWDSAKAAVEDEDFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPTGTVMDIISRKDQRGSGQVGTYGLNTFTNMEAQLIRQMEGEGVLSKADLENPHLPEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLRETACLGKAYAQMWSLMYFHRRDLRLASNAICSAVPVHWVPTSRTTWSIHAHHQWMTTEDMLTVWNRVWIEDNPWMEDKTPVTTWENVPYLGKREDQWCGSLIGLTSRATWAQNIPTAIQQVRSLIGNEEFLDYMPSMKRFRKEEESEGAIW

SEQ ID NO: 4985 - protein, 3290 aa, Artificial Sequence
  derived and/or modified protein sequence (wt) from DENV-3__FJ639792__SS-prME
TSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAVLPEEQDQNYVCKHTYVDRGWGNGCGLFGKGSLVTCAKFQCLEPIEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDVPCKIPFSTEDGQGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSASRAWNVWEVEDYGFGVFTTNIWLKLREVYTQLCDHRLMSAAVKDERAVHADMGYWIESQKNGSWKLEKASLIEVKTCTWPKSHTLWSNGVLESDMIIPKSLAGPISQHNYRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGEVDNFTMGVLCLAILFEEVMRGKFGKKHMIAGVFFTFVLLLSGQITWRDMAHTLIMIGSNASDRMGMGVTYLALIATFKIQPFLALGFFLRKLTSRENLLLGVGLAMATTLQLPEDIEQMANGIALGLMALKLITQFETYQLWTALISLTCSNTIFTLTVAWRTATLILAGVSLLPVCQSSSMRKTDWLPMTVAAMGVPPLPLFIFSLKDTLKRRSWPLNEGVMAVGLVSILASSLLRNDVPMAGPLVAGGLLIACYVITGTSADLTVEKAADVTWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTHNGKRLEPNWASVKRDLISYGGGWRLSAQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAYKVASEGIKYTDRKWCFDGQRNNQILEENMDVEIWTKEGEKKKLRPRWLDARTYSDPLALKEFKDFAAGRKSIALDLVTEIGRVPTHLAHRTRNALDNLVMLHTSEHGGKAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVASVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRSMPGTRRVMGITAEWLWRTLGRNKKPRLCTREEFTKKVRTNAAMGAVFTEENQWDSAKAAVEDEDFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPTGTVMDIISRKDQRGSGQVGTYGLNTFTNMEAQLIRQMEGEGVLSKADLENPHLPEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLRETACLGKAYAQMWSLMYFHRRDLRLASNAICSAVPVHWVPTSRTTWSIHAHHQWMTTEDMLTVWNRVWIEDNPWMEDKTPVTTWENVPYLGKREDQWCGSLIGLTSRATWAQNIPTAIQQVRSLIGNEEFLDYMPSMKRFRKEEESEGAIW

SEQ ID NO: 4986 - protein, 3290 aa, Artificial Sequence
  derived and/or modified protein sequence (wt) from DENV-3__FJ639793__SS-prME
TSLCLMMILPATLAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAVLPEEQDQNYVCKHTYVDRGWGNGCGLFGKGSLVTCAKFQCLEPIEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDVPCKIPFSTEDGQGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSASRAWNVWEVEDYGFGVFTTNIWLKLREVYTQLCDHRLMSAAVKDERAVHADMGYWIESQKNGSWKLEKASLIEVKTCTWPKSHTLWSNGVLESDMIIPKSLAGPISQHNYRPGYHTQTAGPWHLGKLELDFNYCEGTTVVITENCGTRGPSLRTTTVSGKLIHEWCCRSCTLPPLRYMGEDGCWYGMEIRPTSEKEENMVKSLVSAGSGEVDNFTMGVLCLAILFEEVMRGKFGKKHMIAGVFFTFVLLLSGQITWRDMAHTLIMIGSNASDRMGMGVTYLALIATFKIQPFLALGFFLRKLTSRENLLLGVGLAMATTLQLPEDIEQMANGIALGLMALKLITQFETYQLWTALISLTCSNTIFTLTVAWRTATLILAGVSLLPVCQSSSMRKTDWLPMTVAAMGVPPLPLFIFSLKDTLKRRSWPLNEGVMAVGLVSILASSLLRNDVPMAGPLVAGGLLIACYVITGTSADLTVEKAADVTWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTYNGKRLEPNWASVKKDLISYGGGWRLSAQWQKGEEVQVIAVEPGKNPKNFQTMPGTFQTTTGEIGAIALDFKPGTSGSPIINREGKIVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKDFAAGRKSIALDLVTEIGRVPTHLAHRTRNALDNLVMLHTSEHGGKAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSVMKSVGTGKRGTGSQGETLGEKWKKKLNQLSRKEFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVASVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRSMPGTRRVMGITAEWLWRTLGRNKKPRLCTREEFTKKVRTNAAMGAVFTEENQWDSAKAAVEDEDFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPTGTVMDIISRKDQRGSGQVGTYGLNTFTNMEAQLIRQMEGEGVLSKADLENPHLPEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLRETACLGKAYAQMWSLMYFHRRDLRLASNAICSAVPVHWVPTSRTTWSIHAHHQWMTTEDMLTVWNRVWIEDNPWMEDKTPVTTWENVPYLGKREDQWCGSLIGLTSRATWAQNIPTAIQQVRSLIGNEEFLDYMPSMKRFRKEEESEGAIW

SEQ ID NO: 4987 - protein, 3290 aa, Artificial Sequence
  derived and/or modified protein sequence (wt) from DENV-3__FJ639795__SS-prME
TSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAVLPEEQDQNYVCKHTYVDRGWGNGCGLFGKGSLVTCAKFQCLEPIEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDVPCKIPFSTEDGQGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDTIGVLEQGKRTLTPQPMELKYSWKTWGKAKIVTAETQNSSFIIDGPNTPECPSASRAWNVWEVEDYGFGVFTTNIWLKLREVYTQLCDHRLMSAAVKDERAVHADMGYWIESQKNGSWKLEKASLIEVKTCTWPKSHTLWSNGVLESDMIIPKSLAGPISQHNYRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGEVDNFTMGVLCLAILFEEVMRGKFGKKHMIAGVFFTFVLLLSGQITWRDMAHTLIMIGSNASDRMGMGITYLALIATFKIQPFLALGFFLRKLTSRENLLLGVGLAMATTLQLPEDIEQMANGIALGLMALKLITQFETYQLWTALISLTCSNTIFTLTVAWRTATLILAGVSLLPVCQSSSMRKTDWLPMTVAAMGVPPLPLFIFSLKDTLKRRSWPLNEGVMAVGLVSILASSLLRNDVPMAGPLVAGGLLIACYVITGTSADLTVEKAADVTWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTYNGKRLEPNWASVKKDLISYGGGWRLSAQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKDFAAGRKSIALDLVTEIGRVPTHLAHRTRNALDNLVMLHTSEHGGKAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAATIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVASVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRSMPGTRRVMGITAEWLWRTLGRNKKPRLCTREEFTKKVRTNAAMGAVFTEENQWDSAKAAVEDEDFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPTGTVMDIISRKDQRGSGQVGTYGLNTFTNMEAQLIRQMEGEGVLLKADLENPHLPEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLRETACLGKAYAQMWSLMYFHRRDLRLASNAICSAVPVHWVPTSRTTWSIHAHHQWMTTEDMLTVWNRVWIEDNPWMEDKTPVTTWENVPYLGKREDQWCGSLIGLTSRATWAQNIPTAIQQVRSLIGNEEFLDYMPSMKRFRKEEESEGAIW

SEQ ID NO: 4988 - protein, 3290 aa, Artificial Sequence
  derived and/or modified protein sequence (wt) from DENV-3__FJ639798__SS-prME
TSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAVLPEEQDQNYVCKHTYVDRGWGNGCGLFGKGSLVTCAKFQCLEPVEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDVPCKIPFSTEDGQGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSASRAWNVWEVEDYGFGVFTTNIWLKLREVYTQLCDHRLMSAAVKDERAVHADMGYWIESQKNGSWKLEKASLIEVKTCTWPKSHTLWSNGVLESDMIIPKSLAGPISQHNYRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGEVDNFTMGVLCLAILFEEVMRGKFGKKHMIAGVFFTFVLLLSGQITWRDMAHTLIMIGSNASDRMGMGVTYLALIATFKIQPFLALGFFLRKLTSRENLLLGVGLAMATTLQLPEDIEQMANGIALGLMALKLITQFETYQLWTALISLTCSNTIFTLTVAWRTATLILAGVSLLPVCQSSSMRKTDWLPMTVAAMGVPPLPLFIFSLKDTLKRRSWPLNEGVMAVGLVSILASSLLRNDVPMAGPLVAGGLLIACYVITGTSADLTVEKAADVTWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTYNGKRLEPNWASVKKDLISYGGGWRLSAQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKDFAAGRKSIALDLVTEIGRVPTHLAHRTRNALDNLVMLHTSEHGGKAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAATIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRREFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVASVNMVSRLLLNRFTMTHRRPTIEKDVDLGAGTRHINAEPETPNMDVIGERIKRIKEEHNSTWHYDEENPYKTWAYHGSYEVKATGSASSMINGVVKLLTKPWDVVPMVTQMAMTDTTPFGQQRVFKEKVDTRTPRPMPGTRRVMGITAEWLWRTLGRNKKPRLCTREEFTKKVRTNAAMGAVFTEENQWDSAKAAVEDEDFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPTGTVMDIISRKDQRGSGQVGTYGLNTFTNMEAQLIRQMEGEGVLSKADLENPHLPEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLRETACLGKAYAQMWSLMYFHRRDLRLASNAICSAVPVHWVPTSRTTWSIHAHHQWMTTEDMLTVWNRVWIEDNPWMEDKTPVTTWENVPYLGKREDQWCGSLIGLTSRATWAQNIPTAIQQVRSLIGNEEFLDYMPSMKRFRKEEESEGAIW

SEQ ID NO: 4989 - protein, 3290 aa, Artificial Sequence
  derived and/or modified protein sequence (wt) from DENV-3__FJ639799__SS-prME
TSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNVTTDSRCPTQGEAVLPEEQDQNYVCKHTYVDRGWGNGCGLFGKGSLVTCAKFQCLEPIEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDVPCKIPFSTEDGQGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSASRAWNVWEVEDYGFGVFTTNIWLKLREVYTQLCDHRLMSAAVKDERAVHADMGYWIESQKNGSWKLEKASLIEVKTCTWPKSHTLWSNGVLESDMIIPKSLAGPISQHNYRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGEVDNFTMGVLCLAILFEEVMRGKFGKKHMIAGVFFTFVLLLSGQITWRDMAHTLIMIGSNASDRMGMGVTYLALIATFKIQPFLALGFFLRKLTSRENLLLGVGLAMATTLQLPEDIEQMANGIALGLMALKLITQFETYQLWTALISLTCSNTIFTLTVAWRTATLILAGVSLLPVCQSSSMRKTDWLPMTVAAMGVPPLPLFIFSLKDTLKRRSWPLNEGVMAVGLVSILASSLLRNDVPMAGPLVAGGLLIACYVITGTSADLTVEKAADVTWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTYNGKRLEPNWASVKKDLISYGGGWRLSAQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKDFAAGRKSIALDLVTEIGRVPTHLAHRTRNALDNLVMLHTSEHGGKAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAAIIAANEMGLLETTKRDLGMSREPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPAVIEHLERLQRKHGGMLVRNPLSRNSTHEMYWISNGTGNIVASVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRSMPGTRRVMGITAEWLWRTLGRNKKPRLCTREEFTKKVRTNAAMGAVFTEENQWDSAKAAVEDEDFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPTGTVMDIISRKDQRGSGQVGTYGLNTFTNMEAQLIRQMEGEGVLSKADLENPHLPEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLRETACLGKAYAQMWSLMYFHRRDLRLASNAICSAVPVHWVPTSRTTWSIHAHHQWMTTEDMLTVWNRVWIEDNPWMEDKTPVTTWENVPYLGKREDQWCGSLIGLTSRATWAQNIPTAIQQVRSLIGNEEFLDYMPSMKRFRKEEESEGAIW

SEQ ID NO: 4990 - protein, 3290 aa, Artificial Sequence
  derived and/or modified protein sequence (wt) from DENV-3__FJ639800__SS-prME
TSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAVLPEEQDQNYVCKHTYVDRGWGNGCGLFGKGSLVTCAKFQCLEPIEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEVQNSGGTSIFAGHLKCRLKMDKLELKGMSYAMCTNTFVLKKEVSETQHGTILIKVEYKGEDVPCKIPFSTEDGQGKAHNGRLITANPVVTKKEEPVNIEAEPPFGESNIVIGIGDNALRINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDTIGVLEQGKRTLTPQPMELKYSWKTWGKAKIVTAETQNSSFIIDGPNTPECPSASRAWNVWEVEDYGFGVFTTNIWLKLREVYTQLCDHRLMSAAVKDERAVHADMGYWIESQKNGSWKLEKASLIEVKTCTWPKSHTLWSNGVLESDMIIPKSLAGPISQHNYRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGEVDNFTMGVLCLAILFEEVMRGKFGKKHMIAGVFFTFVLLLSGQITWRDMAHTLIMIGSNASDRMGMGVTYLALIATFKIQPFLALGFFLRKLTSRENLLLGVGLAMATTLQLPEDIEQMANGIALGLMALKLITQFETYQLWTALISLTCSNTIFTLTVAWRTATLILAGVSLLPVCQSSSMRKTDWLPMTVAAMGVPPLPLFIFNLKDTLKRRSWPLNEGVMAVGLVSILASSLLRNDVPMAGPLVAGGLLIACYVITGTSADLTVEKAADVTWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTYNGKRLEPNWASVKKDLISYGGGWRLSAQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKDFAAGRKSIALDLVTEIGRVPTHLAHRTRNALDNLVMLHTSEHGGKAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGSGNIVASVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRSMPGTRRVMGITAEWLWRTLGRNKKPRLCTREEFTKKVRTNAAMGAVFTEENQWDSAKAAVEDEDFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPTGTVMDIISRKDQRGSGQVGTYGLNTFTNMEAQLIRQMEGEGVLSKADLENPHLPEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLRETACLGKAYAQMWSLMYFHRRDLRLASNAICSAVPVHWVPTSRTTWSIHAHHQWMTTEDMLTVWNRVWIEDNPWMEDKTPVTTWENVPYLGKREDQWCGSLIGLTSRATWAQNIPTAIQQVRSLIGNEEFLDYMPSMKRFRKEEESEGAIW

SEQ ID NO: 4991 - protein, 3290 aa, Artificial Sequence
  derived and/or modified protein sequence (wt) from DENV-3__FJ639801__SS-prME
TSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAVLPEEQDQNYVCKHTYVDRGWGNGCGLFGKGSLVTCAKFQCLEPIEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDVPCKIPFSTEDGQGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDTIGVLEQGKRTLTPQPMELKYSWKTWGKAKIVTAETQNSSFIIDGPNTPECPSASRAWNVWEVEDYGFGVFTTNIWLKLREVYTQLCDHRLMSAAVKDERAVHADMGYWIESQKNGSWKLEKASLIEVKTCTWPKSHTLWSNGVLESDMIIPKSLAGPISQHNYRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGEVDNFTMGVLCLAILFEEVMRGKFGKKHMIAGVFFTFVLLLSGQITWRDMAHTLIMIGSNASDRMGMGVTYLALIATFKIQPFLALGFFLRKLTSRENLLLGVGLAMATTLQLPEDIEQMANGIALGLMALKLITQFETYQLWTALISLTCSNTIFTLTVAWRTATLILAGVSLLPVCQSSSMRKTDWLPMTVAAMGVPPLPLFIFSLKDTLKRRSWPLNEGVMAVGLVSILASSLLRNDVPMAGPLVAGGLLIACYVITGTSADLTVEKAADVTWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTCNGKRLEPNWASVKKDLISYGGGWRLSAQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKDFAAGRKSIALDLVTEIGRVPTHLAHRTRNALDNLVMLHTSEHGGKAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAATIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKRLNQLSRKEFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVASVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRSMPGTRRVMGITAEWLWRTLGRNKKPRLCTREEFTKKVRTNAAMGAVFTEENQWDSAKAAVEDEDFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPTGTVMDIISRKDQRGSGQVGTYGLNTFTNMEAQLIRQMEGEGVLSKADLENPHLPEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLRETACLGKAYAQMWSLMYFHRRDLRLASNAICSAVPVHWVPTSRTTWSIHAHHQWMTTEDMLTVWNRVWIEDNPWMEDKTPVTTWENVPYLGKREDQWCGSLIGLTSRATWAQNIPTAIQQVRSLIGNEEFLDYMPSMKRFRKEEESEGAIW

SEQ ID NO: 4992 - protein, 3290 aa, Artificial Sequence
  derived and/or modified protein sequence (wt) from DENV-3__KF955471__SS-prME
TSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAVLPEEQDQNYVCKHTYVDRGWGNGCGLFGKGSLVTCAKFQCLEPIEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDVPCKIPFSTEDGQGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSASRAWNVWEVEDYGFGVFTTNIWLKLREVYTQLCDHRLMSAAVKDERAVHADMGYWIESQKNGSWKLEKASLIEVKTCTWPKSHTLWSNGVLESDMIIPKSLAGPISQHNYRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGEVDNFTMGVLCLAILFEEVMRGKFGKKHMIAGVFFTFVLLLSGQITWRDMAHTLIMIGSNASDRMGMGVTYLALIATFKIQPFLALGFFLRKLTSRENLLLGVGLAMATTLQLPEDIEQMANGIALGLMALKLITQFETYQLWTALISLTCSNTIFTLTVAWRTATLILAGVSLLPVCQSSSMRKTDWLPMTVAAMGVPPLPLFIFNLKDTLKRRSWPLNEGVMAVGLVSILASSLLRNDVPMAGPLVAGGLLIACYVITGTSADLTVEKAADVTWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTYNGKRLEPNWASVKKDLISYGGGWRLSAQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKDFAAGRKSIALDLVTEIGRVPTHLAHRTRNALDNLVMLHTSEHGGKAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGSGNIVASVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRSMPGTRRVMGITAEWLWRTLGRNKKPRLCTREEFTKKVRTNAAMGAVFTEENQWDSAKAAVEDEDFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPTGTVMDIISRKDQRGSGQVGTYGLNTFTNMEAQLIRQMEGEGVLSKADLENPHLPEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLRETACLGKAYAQMWSLMYFHRRDLRLASNAICSAVPVHWVPTSRTTWSIHAHHQWMTTEDMLTVWNRVWIEDNPWMEDKTPVTTWENVPYLGKREDQWCGSLIGLTSRATWAQNIPTAIQQVRSLIGNEEFLDYMPSMKRFRKEEESEGAIW

SEQ ID NO: 4993 - protein, 3290 aa, Artificial Sequence
  derived and/or modified protein sequence (wt) from DENV-3__FJ639803__SS-prME
TSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAVLPEEQDQNYVCKHTYVDRGWGNGCGLFGKGSLVTCAKFQCLEPIEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDVPCKIPFSTEDGQGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSASRAWNVWEVEDYGFGVFTTNIWLKLREVYTQLCDHRLMSAAVKDERAVHADMGYWIESQKNGSWKLEKASLIEVKTCTWPKSHTLWSNGVLESDMIIPKSLAGPISQHNYRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGEVDNFTMGVLCLAILFEEVMRGKFGKKHMIAGVFFTFVLLLSGQITWRDMAHTLIMIGSNASDRMGMGVTYLALIATFKIQPFLALGFFLRKLTSRENLLLGVGLAMATTLQLPEDIEQMANGIALGLMALKLITQFETYQLWTALISLTCSNTIFTLTVAWRTATLILAGVSLLPVCQSSSMRKTDWLPMTVAAMGVPPLPLFIFNLKDTLKRRSWPLNEGVMAVGLVSILASSLLRNDVPMAGPLVAGGLLIACYVITGTSADLTVEKAADVTWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTYNGKRLEPNWASVKKDLISYGGGWRLSAQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKDFAAGRKSIALDLVTEIGRVPTHLAHRTRNALDNLVMLHTSEHGGKAYRHAVEELPETMETLLLLGLMILLTGGAMLFLISGKGIGKTSIGLICVIVSSGMLWMAEIPLQWIASAIVLEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGSGNIVASVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRSMPGTRRVMGITAEWLWRTLGRNKKPRLCTREEFTKKVRTNAAMGAVFTEENQWDSAKAAVEDEDFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPTGTVMDIISRKDQRGSGQVGTYGLNTFTNMEAQLIRQMEGEGVLSKADLENPHLPEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLRETACLGKAYAQMWSLMYFHRRDLRLASNAICSAVPVHWVPTSRTTWSIHAHHQWMTTEDMLTVWNRVWIEDNPWMEDKTPVTTWENVPYLGKREDQWCGSLIGLTSRATWAQNIPTAIQQVRSLIGNEEFLDYMPSMKRFRKEEESEGAIW

SEQ ID NO: 4994 - protein, 3290 aa, Artificial Sequence
  derived and/or modified protein sequence (wt) from DENV-3__FJ639804__SS-prME
TSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAVLPEEQDQNYVCKHTYVDRGWGNGCGLFGKGSLVTCAKFQCLEPIEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDVPCKIPFSTEDGQGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSASRAWNVWEVEDYGFGVFTTNIWLKLREVYTQLCDHRLMSAAVKDERAVHADMGYWIESQKNGSWKLEKASLIEVKTCTWPKSHTLWSNGVLESDMIIPKSLAGPISQHNYRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGEVDNFTMGVLCLAILFEEVMRGKFGKKHMIAGVFFTFVLLLSGQITWRDMAHTLIMIGSNASDRMGMGVTYLALIATFKIQPFLALGFFLRKLTSRENLLLGVGLAMATTLQLPEDIEQMANGIALGLMALKLITQFETYQLWTALISLTCSNTIFTLTVAWRTATLILAGVSLLPVCQSSSMRKTDWLPMTVAAMGVPPLPLFIFSLKDTLKRRSWPLNEGVMAVGLVSILASSLLRNDVPMAGPLVAGGLLIACYVITGTSADLTVEKAADVTWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKSQVGVGVQKEGVFHTMWHVTRGAVLTYNGKRLEPNWASVKKDLISYGGGWRLSAQWQKGEEVQVIAVEPGKNPKNFQTMPGTFQTTTGEIGAIALDFKPGTSGSPIINREGKIVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKDFAAGRKSIALDLVTEIGRVPTHLAHRTRNALDNLVMLHTSEHGGKAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAATIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVASVNMVSRLLLNRFTMTYRRPTIEKDVDLGAGTRHVNAEPETPNMDVIGERIERIKEEHNSTWHYDDENPYKTWAYHGSYEVKATGSASSMINGVVKLLTKPWDVVPMVTQMAMTDTTPFGQQRVFKEKVDTRIPRSMPGTRRVMGITAEWLWRTLGRNKKPRLCTREEFTKKVRTNAAMGAVFTEENQWDSAKAAVEDEDFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPTGTVMDIISRKDQRGSGQVGTYGLNTFTNMEAQLIRQMEGEGVLSKADLENPHLPEKKITQWLETKGVERLRRMAISGDDCVVKPIDDRFANALLALNDMGKVRKDIPQWQPSKGWHDWQQVPFCSHHFHELIMKDGRKLVVPCRPQDELIGRARISQGAGWSLRETACLGKAYAQMWSLMYFHRRDLRLASNAICSAVPVHWVPTSRTTWSIHAHHQWMTTEDMLTVWNRVWIEDNPWMEDKTPVTTWENVPYLGKREDQWCGSLIGLTSRATWAQNIPTAIQQVRSLIGNEEFLDYMPSMKRFRKEEESEGAIW

SEQ ID NO: 4995 - protein, 3290 aa, Artificial Sequence
  derived and/or modified protein sequence (wt) from DENV-3__FJ639805__SS-prME
TSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAVLPEEQDQNYVCKHTYVDRGWGNGCGLFGKGSLVTCAKFQCLEPIEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDVPCKIPFSTEDGQGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSASRAWNVWEVEDYGFGVFTTNIWLKLREVYTQLCDHRLMSAAVKDERAVHADMGYWIESQKNGSWKLEKASLIEVKTCTWPKSHTLWSNGVLESDMIIPKSLAGPISQHNYRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGEVDNFTMGVLCLAILFEEVMRGKFGKKHMIAGVFLTFVLLLSGQITWRDMAHTLIMIGSNASDRMGMGVTYLALIATFKIQPFLALGFFLRKLTSRENLLLGVGLAMATTLQLPEDIEQMANGIALGLMALKLITQFETYQLWTALISLTCSNTIFTLTVAWRTATLILAGVSLLPVCQSSSMRKTDWLPMTVAAMGVPPLPLFIFNLKDTLRRRSWPLNEGVMAVGLVSILASSLLRNDVPMAGPLVAGGLLIACYVITGTSADLTVEKAADVTWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTYNGKRLEPNWASVKKDLISYGGGWRLSAQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKDFAAGRKSIALDLVTEIGRVPTHLAHRTRNALDNLVMLHTSEHGGKAYRHAVEELPETMETLLLLGLMILLTGGAMLFLISGKGLGKTSIGLICVIASSGMLWMAEIPLQWIASAIVLEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVASVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVIQMAMTDTTPFGQQRVFKEKVDTRTPRSMPGTRRVMGITAEWLWRTLGRNKKPRLCTREEFTKKVRTNAAMGAVFTEENQWDSAKAAVEDEDFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPTGTVMDIISRKDQRGSGQVGTYGLNTFTNMEAQLIRQMEGEGVLSKADLENPHLPEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLRETACLGKAYAQMWSLMYFHRRDLRLASNAICSAVPVHWVPTSRTTWSIHAHHQWMTTEDMLTVWNRVWIEDNPWMEDKTPVTTWENVPYLGKREDQWCGSLIGLTSRATWAQNIPTAIQQVRSLIGNEEFLDYMPSMKRFRKEEESEGAIW

SEQ ID NO: 4996 - protein, 3290 aa, Artificial Sequence
  derived and/or modified protein sequence (wt) from DENV-3__FJ639807__SS-prME
TSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAVLPEEQDQNYVCKHTYVDRGWGNGCGLFGKGSLVTCAKFQCLEPIEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDVPCKIPFSTEDGQGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDTIGVLEQGKRTLTPQPMELKYSWKTWGKAKIVTAETQNSSFIIDGPNTPECPSASRAWNVWEVEDYGFGVFTTNIWLKLREVYTQLCDHRLMSAAVKDERAVHADMGYWIESQKNGSWKLEKASLIEVKTCTWPKSHTLWSNGVLESDMIIPKSLAGPISQHNYRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGEVDNFTMGVLCLAILFEEVMRGKFGKKHMIAGVFFTFVLLLSGQITWRDMAHTLIMIGSNASDRMGMGVTYLALIATFKIQPFLALGFFLRKLTSRENLLLGVGLAMATTLQLPEDIEQMANGIALGLMALKLITQFETYQLWTALISLTCSNTIFTLTVAWRTATLILAGVSLLPVCQSSSMRKTDWLPMTVAAMGVPPLPLFIFSLKDTLKRRSWPLNEGVMAVGLVSILASSLLRNDVPMAGPLVAGGLLIACYVITGTSADLTVEKAADVTWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTYNGKRLEPNWASVKKDLISYGGGWRLSAQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKDFAAGRKSIALDLVTEIGRVPTHLAHRTRNALDNLVMLHTSEHGGKAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAATIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKRLNQLSRKEFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVASVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRSMPGTRRVMGITAEWLWRTLGRNKKPRLCTREEFTKKVRTNAAMGAVFTEENQWDSAKAAVEDEDFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPTGTVMDIISRKDQRGSGQVGTYGLNTFTNMEAQLIRQMEGEGVLSKADLENPHLPEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLRETACLGKAYAQMWSLMYFHRRDLRLASNAICSAVPVHWVPTSRTTWSIHAHHQWMTTEDMLTVWNRVWIEDNPWMEDKTPVTTWENVPYLGKREDQWCGSLIGLTSRATWAQNIPTAIQQVRSLIGNEEFLDYMPSMKRFRKEEESEGAIW

SEQ ID NO: 4997 - protein, 3290 aa, Artificial Sequence
  derived and/or modified protein sequence (wt) from DENV-3__FJ639810__SS-prME
TSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAVLPEEQDQNYVCKHTYVDRGWGNGCGLFGKGSLVTCAKFQCLEPIEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDVPCKIPFSTEDGQGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQADTGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKARIVTAETQNSSFIIDGPNTPECPNTSRAWNVWEVEDYGFGVFTTNIWLKLREVYTQLCDHRLMSAAVKDERAVHADMGYWIESQKNGSWKLEKASLIEVKTCTWPKSHTLWSNGVLESDMIIPKSLAGPISQHNYRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGEVDNFTMGVLCLAILFEEVMRGKFGKKHMIAGVLFTFVLLLSGQITWRDMAHTLIMIGSNASDRMGMGVTYLALIATFKIQPFLALGFFLRKLTSRENLLLGVGLAMATTLQLPEDIEQMANGIALGLMALKLITQFETYQLWTALISLTCSNTIFTLTVAWRTATLILAGVSLLPVCQSSSMRKTDWLPMTVAAMGVPPLPLFIFCLKDTLKRRSWPLNEGVMAVGLVSILASSLLRNDVPMAGPLVAGGLLIACYVITGTSADLTVEKAADVTWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTYNGKRLEPNWASVKKDLISYGGGWRLSAQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIMPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKDFAAGRKSIALDLVTEIGRVPTHLAHRTRNALDNLVMLHTSEHGGKAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPAVIEHLERLQRKHGGMLVRNPLSRNSTHEMYWISNGTGNIVASVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRSMPGTRRVMGITAEWLWRTLGRNKKPRLCTREEFTKKVRTNAAMGAVFTEENQWDSAKAAVEDEDFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLYNEEKITQQMDPEHRQLANAIFKLTYQNKVVKVQRPTPTGTVMDIISRKDQRGSGQVGTYGLNTFTNMEAQLIRQMEGEGVLSKADLENPHLPEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLRETACLGKAYAQMWSLMYFHRRDLRLASNAICSAVPVHWVPTSRTTWSIHAHHQWMTTEDMLTVWNRVWIEDNPWMEDKTPVTTWENVPYLGKREDQWCGSLIGLTSRATWAQNIPTAIQQVRSLIGNEEFLDYMPSMKRFRKEEESEGAIW

SEQ ID NO: 4998 - protein, 3290 aa, Artificial Sequence
  derived and/or modified protein sequence (wt) from DENV-3__FJ639816__SS-prME
TSLCLMMILPATLAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAVLPEEQDQNYVCKHTYVDRGWGNGCGLFGKGSLVTCAKFQCLEPIEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDVPCKIPFSTEDEQGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKARIVTAETQNSSFIIDGPNTPECPSASRAWNVWEVEDYGFGVFTTNIWLKLREVYTQLCDHRLMSAAVKDERAVHADMGYWIESQKNGSWKLEKASLIEVKTCTWPKSHTLWSNGVLESDMIIPKSLAGPISQHNYRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGEVDNFTMGVLCLAILFEEVMRGKFGKKHMIAGVFFTFVLLLSGQITWRDMAHTLIMIGSNASDRMGMGVTYLALIATFKIQPFLALGFFLRKLTSRENLLLGVGLAMATTLQLPEDIEQMANGIALGLMALKLITQFETYQLWTALISLTCSNTIFTLTVAWRTATLILAGVSLLPVCQSSSMRKTDWLPMTVAAMGVPPLPLFIFSLKDTLKRRSWPLNEGVMAVGLVSILASSLLRNDVPMAGPLVAGGLLIACYVITGTSADLTVEKAADVTWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTYNGKRLEPNWASVKKDLISYGGGWRLSAQWQKGEEVQVIAVEPGKNPKNFQTMPGTFQTTTGEIGAIALDFKPGTSGSPIINREGKIVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKDFAAGRKSIALDLVTEIGRVPTHLAHRTRNALDNLVMLHTSEHGGKAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAATIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSVMKSVGTGKRGTGSQGETLGEKWKKKLNQLSRKEFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVASVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRSMPGTRRVMGITAEWLWRTLGRNKKPRLCTREEFTKKVRTNAAMGAVFTEENQWDSAKAAVEDEDFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPTGTVMDIISRKDQRGSGQVGTYGLNTFTNMEAQLIRQMEGEGVLSKADLENPHLPEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLRETACLGKAYAQMWSLMYFHRRDLRLASNAICSAVPVHWVPTSRTTWSIHAHHQWMTTEDMLTVWNRVWIEDNPWMEDKTPVTTWENVPYLGKREDQWCGSLIGLTSRATWAQNIPTAIQQVRSLIGNEEFLDYMPSMKRFRKEEESEGAIW

SEQ ID NO: 4999 - protein, 3290 aa, Artificial Sequence
  derived and/or modified protein sequence (wt) from DENV-3__FJ639817__SS-prME
TSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNVTTDSRCPTQGEAVLPEEQDQNYVCKHTYVDRGWGNGCGLFGKGSLVTCAKFQCLEPIEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDVPCKIPFSTEDGQGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSRNTSMSFSCIAIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSASRAWNVWEVEDYGFGVFTTNIWLKLREVYTQLCDHRLMSAAVKDERAVHADMGYWIESQKNGSWKLEKASLIEVKTCTWPKSHTLWSNGVLESDMIIPKSLAGPISQHNYRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGEVDNFTMGVLCLAILFEEVMRGKFGKKHMIAGVFFTFVLLLSGQITWRDMAHTLIMIGSNASDRMGMGVTYLALIATFKIQPFLALGFFLRKLTSRENLLLGVGLAMATTLQLPEDIEQMANGIALGLMALKLITQFETYQLWTALISLTCSNTIFTLTVAWRTATLILAGVSLLPVCQSSSMRKTDWLPMTVAAMGVPPLPLFIFSLKDTLKRRSWPLNEGVMAVGLVSILASSLLRNDVPMAGPLVAGGLLIACYVITGTSADLTVEKAADVTWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTYNGKRLEPNWASVKKDLISYGGGWRLSAQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKDFAAGRKSIALDLVTEIGRVPTHLAHRTRNALDNLVMLHTSEHGGKAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAAIIAANEMGLLETTKRDLGMSREPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPAVIEHLERLQRKHGGMLVRNPLSRNSTHEMYWISNGTGNIVASVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRSMPGTRRVMGITAEWLWRTLGRNKKPRLCTREEFTKKVRTNAAMGAVFTEENQWDSAKAAVEDEDFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPTGTVMDIISRKDQRGSGQVGTYGLNTFTNMEAQLIRQMEGEGVLSKADLENPHLPEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLRETACLGKAYAQMWSLMYFHRRDLRLASNAICSAVPVHWVPTSRTTWSIHAHHQWMTTEDMLTVWNRVWIEDNPWMEDKTPVTTWENVPYLGKREDQWCGSLIGLTSRATWAQNIPTAIQQVRSLIGNEEFLDYMPSMKRFRKEEESEGAIW

SEQ ID NO: 5000 - protein, 3290 aa, Artificial Sequence
  derived and/or modified protein sequence (wt) from DENV-3__FJ639825__SS-prME
TSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAVLPEEQDQNYVCKHTYVDRGWGNGCGLFGKGSLVTCAKFQCLEPIEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVDYKGEDVPCKIPFSTEDGQGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQADTGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSASRAWNVWEVEDYGFGVFTTNIWLKLREVYTQQCDHRLMSAAVKDERAVHADMGYWIESQKNGSWKLEKASLIEVKTCTWPKSHTLWSNGVLESDMIIPKSLAGPISQHNYRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGEVDNFTMGVLCLAILFEEVMRGKFGKKHMIAGVFFTFVLLLSGQITWRDMAHTLIMIGSNASDRMGMGVTYLALIATFKIQPFLALGFFLRKLTSRENLLLGVGLAMATTLQLPEDIEQMANGIALGLMALKLITQFETYQLWTALISLTCSNTIFTLTVAWRTATLILAGVSLLPVCQSSSMRKTDWLPMTVAAMGVPPLPLFIFSLKDTLKRRSWPLNEGVMAVGLVSILASSLLRNDVPMAGPLVAGGLLIACYVITGTSADLTVEKAADVTWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTYNGKRLEPNWASVKKDLISYGGGWRLSAQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKDFAAGRKSIALDLVTEIGRVPSHLAHRTRNALDNLVMLHTSEHGGKAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVASVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRSMPGTRRVMGITAEWLWRTLGRNKKPRLCTREEFTKKVRTNAAMGAVFTEENQWDSAKAAVEDEDFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHKQLANAIFKLTYQNKVVKVQRPTPTGTVMDIISRKDQRGSGQVGTYGLNTFTNMEAQLIRQMEGEGVLSKADLENPHLPEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLRETACLGKAYAQMWSLMYFHRRDLRLASNAICSAVPVHWVPTSRTTWSIHAHHQWMTTEDMLTVWNRVWIEDNPWMEDKTPVTTWENVPYLGKREDQWCGSLIGLTSRATWAQNIPTAIQQVRSLIGNEEFLDYMPSMKRFRKEEESEGAIW

SEQ ID NO: 5001 - protein, 3290 aa, Artificial Sequence
  derived and/or modified protein sequence (wt) from DENV-3__FJ639826__SS-prME
TSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAVLPEEQDQNYVCKHTYVDRGWGNGCGLFGKGSLVTCAKFQCLEPIEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDVPCKIPFSTEDGQGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQADTGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKARIVTAETQNSSFIIDGPNTPECPNTSRAWNVWEVEDYGFGVFTTNIWLKLREVYTQLCDHRLMSAAVKDERAVHADMGYWIESQKNGSWKLEKASLIEVKTCTWPKSHTLWSNGVLESDMIIPKSLAGPISQHNYRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGEVDNFTMGVLCLAILFEEVMRGKFGKKHMIAGVFFTFVLLLSGQITWRDMAHTLIMIGSNATDRMGMGVTYLALIATFKIQPFLALGFFLRKLTSRENLLLGVGLAMATTLQLPEDIEQMANGIALGLMALKLITQFETYQLWTALISLTCSNTIFTLTVAWRTATLILAGVSLLPVCQSSSMRKTDWLPMTVAAMGVPPLPLFIFSLKDTLKRRSWPLNEGVMAVGLVSILASSLLRNDVPMAGPLVAGGLLIACYVITGTSADLTVEKAADVTWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTYNGKRLEPNWASVKKDLISYGGGWRLSAQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFTGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKDFAAGRKSIALDLVTEIGRVPTHLAHRTRNALDNLVMLHTSEHGGKAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPAVIEHLERLQRKHGGMLVRNPLSRNSTHEMYWISNGTGNIVASVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRSMPGTRRVMEITAEWLWRTLGRNKKPRLCTREEFTKKVRTNAAMGAVFTEENQWDSAKAAVEDEDFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPTGTVMDIISRKDQRGSGQVGTYGLNTFTNMEAQLIRQMEGEGVLSKADLENPHLPEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLRETACLGKAYAQMWSLMYFHRRDLRLASNAICSAVPVHWVPTSRTTWSIHAHHQWMTTEDMLTVWNRVWIEDNPWMEDKTPVTTWENVPYLGKREDQWCGSLIGLTSRATWAQNIPTAIQQVRSLIGNEEFLDYMPSMKRFRKEEESEGAIW

SEQ ID NO: 5002 - protein, 3290 aa, Artificial Sequence
  derived and/or modified protein sequence (wt) from DENV-3__FJ810416__SS-prME
TSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAVLPEEQDQNYVCKHTYVDRGWGNGCGLFGKGSLVTCAKFQCLEPIEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDVPCKIPFSTEDGQGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSASRAWNVWEVEDYGFGVFTTNIWLKLREVYTQLCDHRLMSAAVKDERAVHADMGYWIESQKNGSWKLEKASLIEVKTCTWPKSHTLWSNGVLESDMIIPKSLAGPISQHNYRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGEVDNFTMGVLCLAILFEEVMRGKFGKKHMIAGVFFTFVLLLSGQITWRDMAHTLIMIGSNASDRMGMGVTYLALIATFKIQPFLALGFFLRKLTSRENLLLGVGLAMATTLQLPEDIEQMANGIALGLMALKLITQFETYQLWTALISLTCSNTIFTLTVAWRTATLILAGVSLLPVCQSSSMRKTDWLPMTVAAMGVPPLPLFIFSLKDTLKRRSWPLNEGVMAVGLVSILASSLLRNDVPMAGPLVAGGLLIACYVITGTSADLTVEKAADVTWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTYNGKRLEPNWASVKKDLISYGGGWRLSAQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKDFAAGRKSIALDLMTEIGRVPSHLAHRTRNALDNLVMLHTSEHGGKAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVVEHLERLQRKHGGMLVRNPLSRNSTHEMYWISNGTGNIVASVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRSMPGTRRVMGITAEWLWRTLGRNKKPRLCTREEFTKKVRTNAAMGAVFTEENQWDSAKAAVEDEDFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPTGTVMDIISRKDQRGSGQVGTYGLNTFTNMEAQLIRQMEGEGVLSKADLENPRLPEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLRETACLGKAYAQMWSLMYFHRRDLRLASNAICSAVPVHWVPTSRTTWSIHAHHQWMTTEDMLTVWNRVWIEDNPWMEDKTPITTWENVPYLGKREDQWCGSLIGLTSRATWAQNIPTAIQQVRSLIGNEEFLDYMPSMKRFRKEEESEGAIW

SEQ ID NO: 5003 - protein, 3290 aa, Artificial Sequence
  derived and/or modified protein sequence (wt) from DENV-3__GQ252678__SS-prME
TSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAVLPEEQDQNYVCKHTYVDRGWGNGCGLFGKGSLVTCAKFQCLEPIEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDVPCKIPFSTEDGQGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSASRAWNVWEVEDYGFGVFTTNIWLKLREVYTQLCDHRLMSAAVKDERAVHADMGYWIESQKNGSWKLEKASLIEVKTCTWPKSHTLWSNGVLESDMIIPKSLAGPISQHNYRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGEVDNFTMGVLCLAILFEEVMRGKFGKKHMIAGVFFTFVLLLSGQITWRDMAHTLIMIGSNASDRMGMGVTYLALIATFKIQPFLALGFFLRKLTSRENLLLGVGLAMATTLQLPEDIEQMANGIALGLMALKLITQFETYQLWTALISLTCSNTIFTLTVAWRTATLILAGVSLLPVCQSSSMRKTDWLPMTVAAMGVPPLPLFIFSLKDTLKRRSWPLNEGVMAVGLVSILASSLLRNDVPMAGPLVAGGLLIACYVITGTSADLTVEKAADVTWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTHNGKRLEPNWASVKKDLISYGGGWRLSAQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKDFAAGRKSIALDLVTEIGRVPTHLAHRTRNALDNLVMLHTSEHGGKAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVASVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRSMPGTRRVMGITAEWLWRTLGRNKKPRLCTREEFTKKVRTNAAMGAVFTEENQWDSAKAAVEDEDFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPTGTVMDIISRKDQRGSGQVGTYGLNTFTNMEAQLIRQMEGEGVLSKADLENPHLPEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLRETACLGKAYAQMWSLMYFHRRDLRLASNAICSAVPVHWVPTSRTTWSIHAHHQWMTTEDMLTVWNRVWIEDNPWMEDKTPVTTWENVPYLGKREDQWCGSLIGLTSRATWAQNISTAIQQVRSLIGNEEFLDYMPSMKRFRKEEESEGAIW

SEQ ID NO: 5004 - protein, 3290 aa, Artificial Sequence
  derived and/or modified protein sequence (wt) from DENV-3__FJ850098__SS-prME
TSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAVLPEEQDQNYVCKHTYVDRGWGNGCGLFGKGSLVTCAKFQCLEPIEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDVPCKIPFSTEDGQGKAHNGRLITANPVVTKKEDPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDVIGVLEQGKRTLTLQPMELKYSWKTWGKAKIVTAETQNSSFIIDGPNTPECPSASRAWNVWEVEDYGFGVFTTNIWLKLREVYTQLCDHRLMSAAVKDERAVHADMGYWIESQKNGSWKLEKASLIEVKTCTWPKSHTLWSNGVLESDMIIPKSLAGPISQHNYRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGEVDNFTMGVLCLAILFEEVMRGKFGKKHMIAGVFFTFVLLLSGQITWRDMAHTLIMIGSNASDRMGMGVTYLALIATFKIQPFLALGFFLRKLTSRENLLLGVGLAMATTLQLPEDIEQMANGIALGLMALKLITQFETYQLWTALISLTCSNTIFTLTVAWRTATLILAGVSLLPVCQSSSMRKTDWLPMTVAAMGVPPLPLFIFSLKDTLKRRSWPLNEGVMAVGLVSILASSLLRNDVPMAGPLVAGGLLIACYVITGTSADLTVEKAADVTWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTYNGKRLEPNWASVKKDLISYGGGWRLSAQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKDFAAGRKSIALDLVTEIGRVPSHLAHRTRNALDNLVMLHTSEHGGKAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVVEHLERLQRKHGGMLVRNPLSRNSTHEMYWISNGTGNIVASVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRSMPGTRRVMGITAEWLWRTLGRNKKPRLCTREEFTKKVRTNAAMGAVFTEENQWDSAKAAVEDEDFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPTGTVMDIISRKDQRGSGQVGTYGLNTFTNMEAQLIRQMEGEGVLSKADLENPRLPEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLRETACLGKAYAQMWSLMYFHRRDLRLASNAICSAVPVHWVPTSRTTWSIHAHHQWMTTEDMLTVWNRVWIEDNPWMEDKTPVTTWENVPYLGKREDQWCGSLIGLTSRATWAQNIPTAIQQVRSLIGNEEFLDYMPSMKRFRKEEESEGAIW

SEQ ID NO: 5005 - protein, 3290 aa, Artificial Sequence
  derived and/or modified protein sequence (wt) from DENV-3__KF955479__SS-prME
TSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAVLPEEQDQNYVCKHTYVDRGWGNGCGLFGKGSLVTCAKFQCLEPIEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDVPCKIPFSTEDGQGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSASRAWNVWEVEDYGFGVFTTNIWLKLREVYTQLCDHRLMSAAVKDERAVHADMGYWIESQKNGSWKLEKASFIEVKTCTWPKSHTLWSNGVLESDMIIPKSLAGPISQHNYRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGEVDNFTMGVLCLAILFEEVMRGKFGKKHMIAGVFFTFVLLLSGQITWRDMAHTLIMIGSNASDRMGMGVTYLALIATFKIQPFLALGFFLRKLTSRENLLLGVGLAMATTLQLPEDIEQMANGIALGLMALKLITQFETYQLWTALISLTCSNTIFTLTVAWRTATLILAGVSLLPVCQSSSMRKTDWLPMTVAAMGVPPLPLFIFSLKDTLKRRSWPLNEGVMAVGLVSILASSLLRNDVPMAGPLVAGGLLIACYVITGTSADLTVEKAADVTWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTYNGKRLEPNWASVKKDLISYGGGWRLSAQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKDFAAGRKSIALDLVTEIGRVPSHLAHRTRNALDNLVMLHTSEHGGKAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVASVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPIVTQMAMTDTTPFGQQRVFKEKVDTRTPRSMPGTRRVMGITAEWLWRTLGRNKKPRLCTREEFTKKVRTNAAMGAVFTEENQWDSAKAAVEDEDFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPTGTVMDIISRKDQRGSGQVGTYGLNTFTNMEAQLIRQMEGEGVLSKADLENPHLPEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLRETACLGKAYAQMWSLMYFHRRDLRLASNAICSAVPVHWVPTSRTTWSIHAHHQWMTTEDMLTVWNRVWIEDNPWMEDKTPVTTWENVPYLGKREDQWCGSLIGLTSRATWAQNIPTAIQQVRSLIGNEEFLDYMPSMKRFRKEEESEGAIW

SEQ ID NO: 5006 - protein, 3290 aa, Artificial Sequence
  derived and/or modified protein sequence (wt) from DENV-3__FJ850109__SS-prME
TSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYTGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAVLPEEQDQNYVCKHTYVDRGWGNGCGLFGKGSLVTCAKFQCLEPIEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDVPCKIPFSTEDGQGKAHNGRLITANPVVTKKEEPVNIEAEPPFGESNIVIGIGDNSLKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQADTGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKARIVTAETQNSSFIIDGPNTPECPNTSRAWNVWEVEDYGFGVFTTNIWLKLREVYTQLCDHRLMSAAVKDERAVHADMGYWIESQKNGSWKLEKASLIEVKTCTWPKSHTLWSNGVLESDMIIPKSLAGPISQHNYRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGEVDNFTMGVLCLAILFEEVMRGKFGKKHMIAGVFFTFVLLLSGQITWRDMAHTLIMIGSNATDRMGMGVTYLALIATFKIQPFLALGFFLRKLTSRENLLLGVGLAMATTLQLPEDIEQMANGIALGLMALKLITQFETYQLWTALISLTCSNTIFTLTVAWRTATLILAGVSLLPVCQSSSMRKTDWLPMTVAAMGVPPLPLFIFSLKDTLKRRSWPLNEGVMAVGLVSILASSLLRNDVPMAGPLVAGGLLIACYVITGTSADLTVEKAADVTWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTYNGKRLEPNWASVKKDLISYGGGWRLSAQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKDFAAGRKSIALDLVTEIGRVPTHLAHRTRNALDNLVMLHTSEHGGKAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPAVIEHLERLQRKHGGMLVRNPLSRNSTHEMYWISNGTGNIVASVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVIQMAMTDTTPFGQQRVFKEKVDTRTPRSMPGTRRVMEITAEWLWRTLGRNKKPRLCTREEFTKKVRTNAAMGAVFTEENQWDSAKAAVEDEDFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPTGTVMDIISRKDQRGSGQVGTYGLNTFTNMEAQLIRQMEGEGVLSKADLENPHLPEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLRETACLGKAYAQMWSLMYFHRRDLRLASNAICSAVPVHWVPTSRTTWSIHAHHQWMTTEDMLTVWNRVWIEDNPWMEDKTPVTTWENVPYLGKREDQWCGSLIGLTSRATWAQNIPTAIQQVRSLIGNEEFLDYMPSMKRFRKEEESEGAIW

SEQ ID NO: 5007 - protein, 3290 aa, Artificial Sequence
  derived and/or modified protein sequence (wt) from DENV-3__GQ868586__SS-prME
TSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAVLPEEQDQNYVCKHTYVDRGWGNGCGLFGKGSLVTCAKFQCLEPIEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVDYKGEDVPCKIPFSTEDGQGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQADTGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSASRAWNVWEVEDYGFGVFTTNIWLKLREVYTQQCDHRLMSAAVKDERAVHADMGYWIESQKNGSWKLEKASLIEVKTCTWPKSHTLWSNGVLESDMIIPKSLAGPISQHNYRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGEVDNFTMGVLCLAILFEEVMRGKFGKKHMIAGVFFTFVLLLSGQITWRDMAHTLIMIGSNASDRMGMGVTYLALIATFKIQPFLALGFFLRKLTSRENLLLGVGLAMATTLQLPEDIEQMANGIALGLMALKLITQFETYQLWTALISLTCSNTIFTLTVAWRTATLILAGVSLLPVCQSSSMRKTDWLPMTVAAMGVPPLPLFIFSLKDTLKRRSWPLNEGVMAVGLVSILASSLLRNDVPMAGPLVAGGLLIACYVITGTSADLTVEKAADVTWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTYNGKRLEPNWASVKKDLISYGGGWRLSAQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKDFAAGRKSIALDLVTEIGRVPSHLAHRTRNALDNLVMLHTSEHGGKAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGEVTHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVASVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRSMPGTRRVMGITAEWLWRTLGRNKKPRLCTREEFTKKVRTNAAMGAVFTEENQWDSAKAAVEDEDFWKLVERERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHKQLANAIFKLTYQNKVVKVQRPTPTGTVMDIISRKDQRGSGQVGTYGLNTFTNMEAQLIRQMEGEGVLSKADLENPHLPEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLRETACLAKAYAQMWSLMYFHRRDLRLASNAICSAVPVHWVPTSRTTWSIHAHHQWMTTEDMLTVWNRVWIEDNPWMEDKTPVTTWENVPYLGKREDQWCGSLIGLTSRATWAQNIPTAIQQVRSLIGNEEFLDYMPSMKRFRKEEESEGAIW

SEQ ID NO: 5008 - protein, 3290 aa, Artificial Sequence
  derived and/or modified protein sequence (wt) from DENV-3__FJ850110__SS-prME
TSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAVLPEEQDQNYVCKHTYVDRGWGNGCGLFGKGSLVTCAKFQCLEPIEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDVPCKIPFSTEDGQGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQADTGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKARIVTAETQNSSFIIDGPNTPECPNTSRAWNVWEVEDYGFGVFTTNIWLKLREVYTQLCDHRLMSAAVKDERAVHADMGYWIESQKNGSWKLEKASLIEVKTCTWPKSHTLWSNGVLESDMIIPKSLAGPISQHNYRPGYHTQTAGPWHLGKLELDFNYCEGTTVVITENCGTRGPSLRTTTVSGKLIHEWCCRSCTLPPLRYMGEDGCWYGMEIRPINEKEENMVKSLVSAGSGEVDNFTMGVLCLAILFEEVMRGKFGKKHMIAGVFFTFVLLLSGQITWRDMAHTLIMIGSNATDRMGMGVTYLALIATFKIQPFLALGFFLRKLTSRENLLLGVGLAMATTLQLPEDIEQMANGIALGLMALKLITQFETYQLWTALISLTCSNTIFTLTVAWRTATLILAGVSLLPVCQSSSMRKTDWLPMTVAAMGVPPLPLFIFSLKDTLKRRSWPLNEGVMAVGLVSILASSLLRNDVPMAGPLVAGGLLIACYVITGTSADLTVEKAADVTWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTYNGKRLEPNWASVKKDLISYGGGWRLSAQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKDFAAGRKSIALDLVTEIGRVPTHLAHRTRNALDNLVMLHTSEHGGKAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPAVIEHLERLQRKHGGMLVRNPLSRNSTHEMYWISNGTGNIVASVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRSMPGTRRVMEITAEWLWRTLGRNKKPRLCTREEFTKKVRTNAAMGAVFTEENQWDSAKAAVEDEDFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPTGTVMDIISRKDQRGSGQVGTYGLNTFTNMEAQLIRQMEGEGVLSKADLENPHLPEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLRETACLGKAYAQMWSLMYFHRRDLRLASNAICSAVPVHWVPTSRTTWSIHAHHQWMTTEDMLTVWNRVWIEDNPWMEDKTPVTTWENVPYLGKREDQWCGSLIGLTSRATWAQNIPTAIQQVRSLIGNEEFLDYMPSMKRFRKEEESEGAIW

SEQ ID NO: 5009 - protein, 3290 aa, Artificial Sequence
  derived and/or modified protein sequence (wt) from DENV-3__FJ850111__SS-prME
TSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAVLPEEQDQNYVCKHTYVDRGWGNGCGLFGKGSLVTCAKFQCLEPIEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDVPCKIPFSTEDGQGKAHNGRLITANPVVTKKEEPVNIEAEPPFGESNIVIGIGDNSLKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQADTGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKARIVTAETQNSSFIIDGPNTPECPNTSRAWNVWEVEDYGFGVFTTNIWLKLREVYTQLCDHRLMSAAVKDERAVHADMGYWIESQKNGSWKLEKASLIEVKTCTWPKSHTLWSNGVLESDMIIPKSLAGPISQHNYRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGEVDNFTMGVLCLAILFEEVMRGKFGKKHMIAGVFFTFVLLLSGQITWRDMAHTLIMIGSNATDRMGMGVTYLALIATFKIQPFLALGFFLRKLTSRENLLLGVGLAMATTLQLPEDIEQMANGIALGLMALKLITQFETYQLWTALISLTCSNTIFTLTVAWRTATLILAGVSLLPVCQSSSMRKTDWLPMTVAAMGVPPLPLFIFSLKDTLKRRSWPLNEGVMAVGLVSILASSLLRNDVPMAGPLVAGGLLIACYVITGTSADLTVEKAADVTWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTYNGKRLEPNWASVKKDLISYGGGWRLSAQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKDFAAGRKSIALDLVTEIGRVPTHLAHRTRNALDNLVMLHTSEHGGKAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPAVIEHLERLQRKHGGMLVRNPLSRNSTHEMYWISNGTGNIVASVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVIQMAMTDTTPFGQQRVFKEKVDTRTPRSMPGTRRVMEITAEWLWRTLGRNKKPRLCTREEFTKKVRTNAAMGAVFTEENQWDSAKAAVEDEDFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPTGTVMDIISRKDQRGSGQVGTYGLNTFTNMEAQLIRQMEGEGVLSKADLENPHLPEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLRETACLGKAYAQMWSLMYFHRRDLRLASNAICSAVPVHWVPTSRTTWSIHAHHQWMTTEDMLTVWNRVWIEDNPWMEDKTPVTTWENVPYLGKREDQWCGSLIGLTSRATWAQNIPTAIQQVRSLIGNEEFLDYMPSMKRFRKEEESEGAIW

SEQ ID NO: 5010 - protein, 3290 aa, Artificial Sequence
  derived and/or modified protein sequence (wt) from DENV-3__KF955486__SS-prME
TSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFTLLMLVTPSMTMRCVGVGNRDFVEGLSGATWVDVVLEHGGCVTTMAKNKPTLDIELQKTEATQLATLRKLCIEGKITNITTDSRCPTQGEAVLPEEQDQNYVCKHTYVDRGWGNGCGLFGKGSLVTCAKFQCLEPIEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDVPCKIPFSTEDGQGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSASRAWNVWEVEDYGFGVFTTNIWLKLREVYTQLCDHRLMSAAVKDERAVHADMGYWIESQKNGSWKLEKASLIEVKTCTWPKSHTLWSNGVLESDMIIPKSLAGPISQHNYRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGEVDNFTMGVLCLAILFEEVMRGKFGKKHMIAGVFFTFVLLLSGQITWRDMAHTLIMIGSNASDRMGMGVTYLALIATFKIQPFLALGFFLRKLTSRENLLLGVGLAMATTLQLPEDIEQMANGIALGLMALKLITQFETYQLWTALISLTCSNTIFTLTVAWRTATLILAGVSLLPVCQSSSMRKTDWLPMTVAAMGVPPLPLFIFSLKDTLKRRSWPLNEGVMAVGLVSILASSLLRNDVPMAGPLVAGGLLIACYVITGTSADLTVEKAADVTWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTYNGKRLEPNWASVKKDLISYGGGWRLSAQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEEKDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKDFAAGRKSIALDLVTEIGRVPTHLAHRTRNALDNLVMLHTSEHGGKAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVASVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRSMPGTRRVMGITAEWLWRTLGRNKKPRLCTREEFTKKVRTNAAMGAVFTEENQWDSAKAAVEDEDFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPTGTVMDIISRKDQRGSGQVGTYGLNTFTNMEAQLIRQMEGEGVLSKADLENPHLPEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLRETACLGKAYAQMWSLMYFHRRDLRLASNAICSAVPVHWVPTSRTTWSIHAHHQWMTTEDMLTVWNRVWIEDNPWMEDKTPVTTWENVPYLGKREDQWCGSLIGLTSRATWAQNIPTAIQQVRSLIGNEEFLDYMPSMKRFRKEEESEGAIW

SEQ ID NO: 5011 - protein, 3290 aa, Artificial Sequence
  derived and/or modified protein sequence (wt) from DENV-3__FJ898468__SS-prME
TSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAVLPEEQDQNYVCKHTYVDRGWGNGCGLFGKGSLVTCAKFQCLEPIEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDVPCKIPFSTEDGQGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDVIGVLEQGKRTLTPQPMELKYSWKTWGKAKIVTAETQNSSFIIDGPNTPECPSASRAWNVWEVEDYGFGVFTTNIWLKLREVYTQLCDHRLMSAAVKDERAVHADMGYWIESQKNGSWKLEKASLIEVKTCTWPKSHTLWSNGVLESDMIIPKSLAGPISQHNYRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGEVDNFTMGVLCLAILFEEVMRGKFGKKHMIAGVFFTFVLLLSGQITWRDMAHTLIMIGSNASDRMGMGVTYLALIATFKIQPFLALGFFLRKLTSRENLLLGVGLAMATTLQLPEDIEQMANGIALGLMALKLITQFETYQLWTALISLTCSNTIFTLTVAWRTATLILAGVSLLPVCQSSSMRKTDWLPMTVAAMGVPPLPLFIFSLKDTLKRRSWPLNEGVMAVGLVSILASSLLRNDVPMAGPLVAGGLLIACYVITGTSADLTVEKAADVTWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTYNGKRLEPNWASVKKDLISYGGGWRLSAQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKDFAAGRKSIALDLVTEIGRVPSHLAHRTRNALDNLVMLHTSEHGGKAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVVEHLERLQRKHGGMLVRNPLSRNSTHEMYWISNGTGNIVASVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRSMPGTRRVMGITAEWLWRTLGRNKKPRLCTREEFTKKVRTNAAMGAVFTEENQWDSAKAAVEDEDFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPTGTVMDIISRKDQRGSGQVGTYGLNTFTNMEAQLIRQMEGEGVLSKADLENPRLPEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLRETACLGKAYAQMWSLMYFHRRDLRLASNAICSAVPVHWVPTSRTTWSIHAHHQWMTTEDMLTVWNRVWIEDNPWMEDKTPVTTWENVPYLGKREDQWCGSLIGLTSRATWAQNIPTAIQQVRSLIGNEEFLDYMPSMKRFRKEEESEGAIW

SEQ ID NO: 5012 - protein, 3290 aa, Artificial Sequence
  derived and/or modified protein sequence (wt) from DENV-3__FJ898469__SS-prME
TSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAVLPEEQDQNYVCKHTYVDRGWGNGCGLFGKGSLVTCAKFQCLEPIEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDVPCKIPFSTEDGQGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSASRAWNVWEVEDYGFGVFTTNIWLKLREVYTQLCDHRLMSAAVKDERAVHADMGYWIESQKNGSWKLEKASLIEVKTCTWPKSHTLWSNGVLESDMIIPKSLAGPISQHNYRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGEVDNFTMGVLCLAILFEEVMRGKFGKKHMIAGVFFTFVLLLSGQITWRDMAHTLIMIGSNASDRMGMGVTYLALIATFKIQPFLALGFFLRKLTSRENLLLGVGLAMATTLQLPEDIEQMANGIALGLMALKLITQFETYQLWTALISLTCSNTIFTLTVAWRTATLILAGVSLLPVCQSSSMRKTDWLPMTVAAMGVPPLPLFIFSLKDTLKRRSWPLNEGVMAVGLVSILASSLLRNDVPMAGPLVAGGLLIACYVITGTSADLTVEKAADVTWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTYNGKRLEPNWASVKKDLISYGGGWRLSAQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKDFAAGRKSIALDLVTEIGRVPTHLAHRTRNALDNLVMLHTSEHGGKAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGLQGETLGEKWKKKLNQLSRKEFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVASVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRSMPGTRRVMGITAEWLWRTLGRNKKPRLCTREEFTKKVRTNAAMGAVFTEENQWDSAKAAVEDEDFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPTGTVMDIISRKDQRGSGQVGTYGLNTFTNMEAQLIRQMEGEGVLSKADLENPHLPEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLRETACLGKAYAQMWSLMYFHRRDLRLASNAICSAVPVHWVPTSRTTWSIHAHHQWMTTEDMLTVWNRVWIEDNPWMEDKTPVTTWENVPYLGKREDQWCGSLIGLTSRATWAQNIPTAIQQVRSLIGNEEFLDYMPSMKRFRKEEESEGAIW

SEQ ID NO: 5013 - protein, 3290 aa, Artificial Sequence
  derived and/or modified protein sequence (wt) from DENV-3__FJ898470__SS-prME
TSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAVLPEEQDQNYVCKHTYVDRGWGNGCGLFGKGSLVTCAKFQCLEPIEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDVPCKIPFSTEDGQGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSASRAWNVWEVEDYGFGVFTTNIWLKLREVYTQLCDHRLMSAAVKDERAVHADMGYWIESQKNGSWKLEKASLIEVKTCTWPKSHTLWSNGVLESDMIIPKSLAGPISQHNYRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGEVDNFTMGVLCLAILFEEVMRGKFGKKHMIAGVFFTFVLLLSGQITWRDMAHTLIMIGSNASDRMGMGVTYLALIATFKIQPFLALGFFLRKLTSRENLLLGVGLAMATTLQLPEDIEQMANGIALGLMALKLITQFETYQLWTALISLTCSNTIFTLTVAWRTATLILAGVSLLPVCQSSSMRKTDWLPMTVAAMGVPPLPLFIFSLKDTLKRRSWPLNEGVMAVGLVSILASSLLRNDVPMAGPLVAGGLLIACYVITGTSADLTVEKAADVTWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTYNGKRLEPNWASVKKDLISYGGGWRLSAQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKDFAAGRKSIALDLVTEIGRVPTHLAHRTRNALDNLVMLHTSEHGGKAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVASVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRSMPGTRRVMGITAEWLWRTLGRNKKPRLCTREEFTKKVRTNAAMGAVFTEENQWDSAKAAVEDEDFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPAGTVMDIISRKDQRGSGQVGTYGLNTFTNMEAQLIRQMEGEGVLSKADLENPHLPEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLRETACLGKAYAQMWSLMYFHRRDLRLASNAICSAVPVHWVPTSRTTWSIHAHHQWMTTEDMLTVWNRVWIEDNPWMEDKTPVTTWENVPYLGKREDQWCGSLIGLTSRATWAQNIPTAIQQVRSLIGNEEFLDYMPSMKRFRKEEESEGAIW

SEQ ID NO: 5014 - protein, 3290 aa, Artificial Sequence
  derived and/or modified protein sequence (wt) from DENV-3__FJ898471__SS-prME
TSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLIQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAVLPEEQDQNYVCKHTYVDRGWGNGCGLFGKGSLVTCAKFQCLEPIEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDVPCKIPFSTEDGQGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIVIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSASRAWNVWEVEDYGFGVFTTNIWLKLREVYTQLCDHRLMSAAVKDERAVHADMGYWIESQKNGSWKLEKASLIEVKTCTWPKSHTLWSNGVLESDMIIPKSLAGPISQHNYRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGEVDNFTMGVLCLAILFEEVMRGKFGKKHMIAGVFFTFVLLLSGQITWRDMAHTLIMIGSNASDRMGMGVTYLALIATFKIQPFLALGFFLRKLTSRENLLLGVGLAMATTLQLPEDIEQMANGIALGLMALKLITQFETYQLWTALVSLTCSNTIFTLTVAWRTATLILAGVSLLPVCQSSSMRKTDWLPMTVAAMGVPPLPLFIFSLKDTLKRRSWPLNEGVMAVGLVSILASSLLRNDVPMAGPLVAGGLLIACYVITGTSADLTVEKAADVTWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTYNGKRLEPNWASVKKDLISYGGGWRLSAQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAYKVASEGIKYTDRKWCFDGQRNNQILEENMDVEIWTKEGEKKKLRPRWLDARTYSDPLALKEFKDFAAGRKSIALDLVTEIGRVPSHLAHRTRNALDNLVMLHTSEHGGKAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVASVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRSMPGTRRVMGITAEWLWRTLGRNKKPRLCTREEFTKKVRTNAAMGAVFTEENQWDSAKAAVEDEDFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPTGTVMDIISRKDQRGSGQVGTYGLNTFTNMEAQLIRQMEGEGVLSKADLENPHLPEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLRETACLGKAYAQMWSLMYFHRRDLRLASNAICSAVPVHWVPTSRTTWSIHAHHQWMTTEDMLTVWNRVWIEDNPWMEDKTPVTTWENVPYLGKREDQWCGSLIGLTSRATWAQNIPTAIQQVRSLIGNEEFLDYMPSMKRFRKEEESEGAIW

SEQ ID NO: 5015 - protein, 3290 aa, Artificial Sequence
  derived and/or modified protein sequence (wt) from DENV-3__FJ898472__SS-prME
TSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAVLPEEQDQNYVCKHTYVDRGWGNGCGLFGKGSLVTCAKFQCLEPIEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDVPCKIPFSTEDGQGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSASRAWNVWEVEDYGFGVFTTNIWLKLREVYTQLCDHRLMSAAVKDERAVHADMGYWIESQKNGSWKLEKASLIEVKTCTWPKSHTLWSNGVLESDMIIPKSLAGPISQHNYRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGEVDNFTMGVLCLAILFEEVMRGKFGKKHMIAGVFLTFVLLLSGQITWRDMAHTLIMIGSNASDRMGMGVTYLALIATFKIQPFLALGFFLRKLTSRENLLLGVGLAMATTLQLPEDIEQMANGIALGLMALKLITQFETYQLWTALISLTCSNTIFTLTVAWRTATLILAGVSLLPVCQSSSMRKTDWLPMTVAAMGVPPLPLFIFNLKDTLKRRSWPLNEGVMAVGLVSILASSLLRNDVPMAGPLVAGGLLIACYVITGTSADLTVEKAADVTWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTYNGKRLEPNWASVKKDLISYGGGWRLSAQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKDFAAGRKSIALDLVTEIGRVPTHLAHRTRNALDNLVMLHTSEHGGKAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVASVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRSMPGTRRVMGITAEWLWRTLGRNKKPRLCTREEFTKKVRTNAAMGAVFTEENQWDSAKAAVEDEDFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPTGTVMDIISRKDQRGSGQVGTYGLNTFTNMEAQLIRQMEGEGVLSKADLENPHLPEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLRETACLGKAYAQMWSLMYFHRRDLRLASNAICSAVPVHWVPTSRTTWSIHAHHQWMTTEDMLTVWNRVWIEDNPWMEDKTPVTTWENVPYLGKREDQWCGSLIGLTSRATWAQNIPTAIQQVRSLIGNEEFLDYMPSMKRFRKEEESEGAIW

SEQ ID NO: 5016 - protein, 3290 aa, Artificial Sequence
  derived and/or modified protein sequence (wt) from DENV-3__FJ898474__SS-prME
TSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAALPEEQDQNYVCKHTYVDRGWGNGCGLFGKGSLVTCAKFQCLEPIEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDVPCKIPFSTEDGQGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIMTAETQNSSFIIDGPNTPECPSASRAWNVWEVEDYGFGVFTTNIWLKLREVYTQLCDHRLMSAAIKDERAVHADMGYWIESQKNGSWKLEKASLIEVKTCTWPKSHTLWSNGVLESDMIIPKGLAGPISQHNHRPGYHTQTAGPWHLGKLELDFNYCEGTTVVITENCGTRGPSLRTTTVSGKLIHEWCCRSCTLPPLRYIGEDGCWYGMEIRPISEKEENMVKSLVSAGSGKVDNFTMGVLCLAILFEEVMRGKFGKKHMIAGVFFTFVLLLSGQITWRDMAHTLIMIGSNASDRMGMGVTYLALIATFKIQPFLALGFFLRKLTSRENLLLGVGLAMATTLQLPEDIEQMANGIALGLMALKLITQFETYQLWTALISLTCSNTIFTLTVAWRTATLILAGVSLLPVCQSSSMRKTDWLPMAVAAMGVPPLPLFIFSLKDTLKRRSWPLNEGVMAVGLVSILASSLLRNDVPMAGPLVAGGLLIACYVITGTSADLTVEKAADITWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTYNGKRLEPNWASVKKDLISYGGGWRLSAQWQKGEEVQVIAVEPGKNPKNFQTMPGTFQTITGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKDFAAGRKSIALDLVTEIGRVPSHLAHRTRNALDNLVMLHTSEHGGRAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGETTHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVASVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRSMPGTRRVMGITAEWLWRTLGRNKKPRLCTREEFTKKVRTNAAMGAVFTEENQWDSAKAAVEDEDFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPTGTVMDIISRKDQRGSGQVGTYGLNTFTNMEAQLIRQMEGEGVLSKADLESPHLPEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLRETACLGKAYAQMWSLMYFHRRDLRLASNAICSAVPVHWVPTSRTTWSIHAHHQWMTTEDMLTVWNRVWIEDNPWMEDKTPVTTWENVPYLGKREDQWCGSLIGLTSRATWAQNIPTAIQQVRSLIGNEEFLDYMPSMKRFRKEEESEGAIW

SEQ ID NO: 5017 - protein, 3290 aa, Artificial Sequence
  derived and/or modified protein sequence (wt) from DENV-3__EU529688__SS-prME
TSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAVLPEEQDQNYVCKHTYVDRGWGNGCGLFGKGSLVTCAKFQCLEPIEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDVPCKIPFSTEDGQGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDTIGVLEQGKRTLTPQPMELKYSWKTWGKAKIVTAETQNSSFIIDGPNTPECPSASRAWNVWEVEDYGFGVFTTNIWLKLREVYTQLCDHRLMSAAVKDERAVHADMGYWIESQKNGSWKLEKASLIEVKTCTWPKSHTLWSNGVLESDMIIPKSLAGPISQHNYRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGEVDNFTMGVLCLAILFEEVMRGKFGKKHMIAGVFFTFVLLLSGQITWRDMAHTLIMIGSNASDRMGMGVTYLALIATFKIQPFLALGFFLRKLTSRENLLLGVGLAMATTLQLPEDIEQMANGIALGLMALKLITQFETYQLWTALISLTCSNTIFTLTVAWRTATLILAGVSLLPVCQSSSMRKTDWLPMTVAAMGVPPLPLFIFSLKDTLKRRSWPLNEGVMAVGLVSILASSLLRNDVPMAGPLVAGGLLIACYVITGTSADLTVEKAADVTWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTYNGKRLEPNWASVKKDLISYGGGWRLSAQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKDFAAGRKSIALDLVTEIGRVPSHLAHRTRNALDNLVMLHTSEHGGKAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVASVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRSMPGTRRVMGITAEWLWRTLGRNKKPRLCTREEFTKKVRTNAAMGAVFTEENQWDSAKAAVEDEDFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPTGTVMDIISRKDQRGSGQVGTYGLNTFTNMEAQLIRQMEGEGVLSKADLENPHLPEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLRETACLGKAYAQMWSLMYFHRRDLRLASNAICSAVPVHWVPTSRTTWSIHAHHQWMTTEDMLTVWNRVWIEDNPWMEDKTPVTTWENVPYLGKREDQWCGSLIGLTSRATWAQNIPTAIQQVRSLIGNEEFLDYMPSMKRFRKEEESEGAIW

SEQ ID NO: 5018 - protein, 3290 aa, Artificial Sequence
  derived and/or modified protein sequence (wt) from DENV-3__EU482613__SS-prME
TSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAVLPEEQDQNYVCKHTYVDRGWGNGCGLFGKGSLVTCAKFQCLEPIEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDVPCKIPFSTEDGQGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSASRAWNVWEVEDYGFGVFTTNIWLKLREVYTQLCDHRLMSAAVKDERAVHADMGYWIESQKNGSWKLEKASLIEVKTCTWPKSHTLWSNGVLESDMIIPKSLAGPISQHNYRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGEVDNFTMGVLCLAILFEEVMRGKFGKKHMIAGVFFTFVLLLSGQITWRDMAHTLIMIGSNASDRMGMGVTYLALIATFKIQPFLALGFFLRKLTSRENLLLGVGLAMATTLQLPEDIEQMANGIALGLMALKLITQFETYQLWTALISLTCSNTIFTLTVAWRTATLILAGVSLLPVCQSSSMRKTDWLPMTVAAMGVPPLPLFIFSLKDTLKRRSWPLNEGVMAVGLVSILASSLLRNDVPMAGPLVAGGLLIACYVITGTSADLTVEKAADVTWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTYNGKRLEPNWASVKKDLISYGGGWRLSAQWQKGEEVQVIAVEPGKNPKNFQTMPGTFQTTTGEIGAIALDFKPGTSGSPIINREGKIVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKDFAAGRKSIALDLVTEIGRVPTHLAHRTRNALDNLVMLHTSEHGGKAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVASVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRSMPGTRRVMGITAEWLWRTLGRNKKPRLCTREEFTKKVRTNAAMGAVFTEENQWDSAKAAVEDEDFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPTGTVMDIISRKDQRGSGQVGTYGLNTFTNMEAQLIRQMEGEGVLSKADLENPHLPEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLRETACLGKAYAQMWSLMYFHRRDLRLASNAICSAVPVHWVPTSRTTWSIHAHHQWMTTEDMLTVWNRVWIEDNPWMEDKTPVTTWENVPYLGKREDQWCGSLIGLTSRATWAQNIPTAIQQVRSLIGNEEFLDYMPSMKRFRKEEESEGAIW

SEQ ID NO: 5019 - protein, 3290 aa, Artificial Sequence
  derived and/or modified protein sequence (wt) from DENV-3__EU529690__SS-prME
TSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAVLPEEQDQNYVCKHTYVDRGWGNGCGLFGKGSLVTCAKFQCLEPIEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDVPCKIPFSTEDGQGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQADTGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSASRAWNVWEVEDYGFGVFTTNIWLKLREVYTQLCDHRLMSAAVKDERAVHADMGYWIESQKNGSWKLEKASLIEVKTCTWPKSHTLWSNGVLESDMIIPKSLAGPISQHNYRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGEVDNFTMGVLCLAILFEEVMRGKFGKKHMIAGVFFTFVLLLSGQITWRDMAHTLIMIGSNASDRMGMGVTYLALIATFKIQPFLALGFFLRKLTSRENLLLGVGLAMATTLQLPEDIEQMANGIALGLMALKLITQFETYQLWTALISLTCSNTIFTLTVAWRTATLILAGVSLLPVCQSSSMRKTDWLPMTVAAMGVPPLPLFIFNLKDTLKRRSWPLNEGVMAVGLVSILASSLLRNDVPMAGPLVAGGLLIACYVITGTSADLTVEKAADVTWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTYNGKRLEPNWASVKKDLISYGGGWRLSAQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKDFAAGRKSIALDLVTEIGRVPTHLAHRTRNALDNLVMLHTSEHGGKAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVASVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRSMPGTRRVMGITAEWLWRTLGRNKKPRLCTREEFTKKVRTNAAMGAVFTEENQWDSAKAAVEDEDFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPTGTVMDIISRKDQRGSGQVGTYGLNTFTNMEAQLIRQMEGEGVLSKADLENPHLPEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLRETACLGKAYAQMWSLMYFHRRDLRLASNAICSAVPVHWVPTSRTTWSIHAHHQWMTTEDMLTVWNRVWIEDNPWMEDKTPVTTWENVPYLGKREDQWCGSLIGLTSRATWAQNIPTAIQQVRSLIGNEEFLDYMPSMKRFRKEEESEGAIW

SEQ ID NO: 5020 - protein, 3290 aa, Artificial Sequence
  derived and/or modified protein sequence (wt) from DENV-3__EU529691__SS-prME
TSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAVLPEEQDQNYVCKHTYVDRGWGNGCGLFGKGSLVTCAKFQCLEPIEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDAPCKIPFSTEDGQGKAHSGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAVGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSASRAWNVWEVEDYGFGVFTTNIWLKLREVYTQLCDHRLMSAAVKDERAVHADMGYWIESQKNGSWKLEKASLIEVKTCTWPKSHTLWSNGVLESDMIIPKSLAGPISQHNHRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGKVDNFTMGVLCLAILFEEVMRGKFGKKHMIAGVFFTFVLLLSGQITWRDMAHTLIMIGSNASDRMGMGVTYLALIATFKIQPFLALGFFLRKLTSRENLLLGVGLAMATTLQLPEDIEQMANGIALGLMALKLITQFETYQLWTALISLTCSNTMFTLTVAWRTATLILAGVSLLPVCQSSSMRKTDWLPMAVAAMGVPPLPLFIFSLKDTLKRRSWPLNEGVMAVGLVSILASSLLRNDVPMAGPLVAGGLLIACYVITGTSADLTVEKAADITWEEEAEQTGVSHNLMITVDDDGTMRIKDDETENILTVLLKTALLIVSGVFPYSIPATLLVWHTWQKQTQRSGVLWDVPSPPETQKAELEEGVYRIKQQGIFGKTQVGVGVQKEGVFHTMWHVTRGAVLTYNGKRLEPNWASVKKDLISYGGGWRLSAQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKDFAAGRKSIALDLVTEIGRVPSHLAHRTRNALDNLVMLHTSEHGGRAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGETTHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVASVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRSMPGTRRVMGITAEWLWRTLGRNKKPRLCTREEFTKKVRTNAAMGAVFTEENQWDSAKAAVEDEDFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPTGTVMDIISRKDQRGSGQVGTYGLNTFTNMEAQLIRQMEGEGVLSKADLENPHLPEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLRETACLGKAYAQMWSLMYFHRRDLRLASNAICSAVPVHWVPTSRTTWSIHAHHQWMTTEDMLTVWNRVWIEDNPWMEDKTPVTTWENVPYLGKREDQWCGSLIGLTSRATWAQNIPTAIQQVRSLIGNEEFLDYMPSMKRFRKEEESEGAIW

SEQ ID NO: 5021 - protein, 3290 aa, Artificial Sequence
  derived and/or modified protein sequence (wt) from DENV-3__EU569689__SS-prME
TSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAVLPEEQDQNYVCKHTYVDRGWGNGCGLFGKGSLVTCAKFQCLEPIEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDVPCKIPFSTEDGQGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKAWGKAKIVTAETQNSSFIIDGPNTPECPSASRAWNVWEVEDYGFGVFTTNIWLKLREVYTQLCDHRLMSAAVKDERAVHADMGYWIESQKNGSWKLEKASLIEVKTCTWPKSHTLWSNGVLESDMIIPKSLAGPISQHNYRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGEVDNFTMGVLCLAILFEEVMRGKFGKKHMIAGVFFTFVLLLSGQITWRDLAHTLIMIGSNASDRMGMGVTYLALIATFKIQPFLALGFFLRKLTSRENLLLGVGLAMATTLQLPEDIEQMANGIALGLMALKLITQFETYQLWTALISLTCSNTIFTLTVAWRTATLILAGVSLLPVCQSSSMRKTDWLPMTVAAMGVPPLPLFIFSLKDTLKRRSWPLNEGVMAVGLVSILASSLLRNDVPMAGPLVAGGLLIACYVITGTSADLTVEKAADVTWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTYNGKRLEPNWASVKKDLISYGGGWRLSAQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKDFAAGRKSIALDLVTEIGRVPTHLAHRTRNALDNLVMLHTSEHGGKAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVASVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRSMPGTRRVMGITAEWLWRTLGRNKKPRLCTREEFTKKVRTNAAMGAVFTEENQWDSAKAAVEDEDFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPTGTVMDIISRKDQRGSGQVGTYGLNTFTNMEAQLIRQMEGEGVLSKADLENPHLPEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLRETACLGKAYAQMWSLMYFHRRDLRLASNAICSAVPVHWVPTSRTTWSIHAHHQWMTTEDMLTVWNRVWIEDNPWMEDKTPVTTWENVPYLGKREDQWCGSLIGLTSRATWAQNIPTAIQQVRSLIGNEEFLDYMPSMKRFRKEEESEGAIW

SEQ ID NO: 5022 - protein, 3290 aa, Artificial Sequence
  derived and/or modified protein sequence (wt) from DENV-3__EU482614__SS-prME
TSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAVLPEEQDQNYVCKHTYVDRGWGNGCGLFGKGSLVTCAKFQCLEPIEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDVPCKIPFSTEDGQGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSASRAWNVWEVEDYGFGVFTTNIWLKLREVYTQLCDHRLMSAAVKDERAVHADMGYWIESQKNGSWKLEKASLIEVKTCTWPKSHTLWSNGVLESDMIIPKSLAGPISQHNYRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGEVDNFTMGVLCLAILFEEVMRGKFGKKHMIAGVFFTFVLLLSGQITWRDMAHTLIMIGSNASDRMGMGVTYLALIATFKIQPFLALGFFLRKLTSRENLLLGVGLAMATTLQLPEDIEQMANGIALGLMALKLITQFETYQLWTALISLTCSNTIFTLTVAWRTATLILAGVSLLPVCQSSSMRKTDWLPMTVAAMGVPPLPLFIFSLKDTLKRRSWPLNEGVMAVGLVSILASSLLRNDVPMAGPLVAGGLLIACYVITGTSADLTVEKAADVTWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTHNGKRLEPNWASVKKDLISYGGGWRLSAQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKDFAAGRKSIALDLVTEIGRVPSHLAHRTRNALDNLVMLHTSEHGGKAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVASVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRSMPGTRRVMGITAEWLWRTLGRNKKPRLCTREEFTKKVRTNAAMGAVFTEENQWDSAKAAVEDEDFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPTGTVMDIISRKDQRGSGQVGTYGLNTFTNMEAQLIRQMEGEGVLSKADLENPHLPEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLRETACLGKAYAQMWSLMYFHRRDLRLASNAICSAVPVHWVPTSRTTWSIHAHHQWMTTEDMLTVWNRVWIEDNPWMEDKTPVTTWENVPYLGKREDQWCGSLIGLTSRATWAQNIPTAIQQVRSLIGNEEFLDYMPSMKRFRKEEESEGAIW

SEQ ID NO: 5023 - protein, 3290 aa, Artificial Sequence
  derived and/or modified protein sequence (wt) from DENV-3__EU569690__SS-prME
TSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAVLPEEQDQNYVCKHTYVDRGWGNGCGLFGKGSLVTCAKFQCLEPIEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTETPTWSRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDVPCKIPFSTEDEQGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLIPQPMELKYSWKTWGKAKIVTAETQNSSFIIDGPNTPECPSASRAWNVWEVEDYGFGVFTTNIWLKLREVYTQLCDHRLMSAAVKDERAVHADMGYWIESQKNGSWKLEKASLIEVKTCTWPKSHTLWSNGVLESDMIIPKSLAGPISQHNYRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGEVDNFTMGVLCLAILFEEVMRGKFGKKHMIAGVFFTFVLLLSGQITWRDMAHTLIMIGSNASDRMGMGVTYLALIATFKIQPFLALGFFLRKLTSRENLLLGVGLAMATTLQLPEDIEQMANGIALGLMALKLITQFETYQLWTALISLTCSNTIFTLTVAWRTATLILAGVSLLPVCQSSSMRKTDWLPMTVAAMGVPPLPLFIFSLKDTLKRRSWPLNEGVMAVGLVSILASSLLRNDVPMAGPLVAGGLLIACYVITGTSADLTVEKAADVTWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTYNGKRLEPNWASVKKDLISYGGGWRLSAQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKDFAAGRKSIALDLVTEIGRVPTHLAHRTRNALDNLVMLHTSEHGGKAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVASVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRSMPGTRRVMGITAEWLWRTLGRNKKPRLCTREEFTKKVRTNAAMGAVFTEENQWDSAKAAVEDEDFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPTGTVMDIISRKDQRGSGQVGTYGLNTFTNMEAQLIRQMEGEGVLSKADLENPHLPEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLRETACLGKAYAQMWSLMYFHRRDLRLASNAICSAVPVHWVPTSRTTWSIHAHHQWMTTEDMLTVWNRVWIEDNPWMEDKTPVTTWENVPYLGKREDQWCGSLIGLTSRATWAQNIPTAIQQVRSLIGNEEFLDYMPSMKRFRKEEESEGAIW

SEQ ID NO: 5024 - protein, 3290 aa, Artificial Sequence
  derived and/or modified protein sequence (wt) from DENV-3__EU569691__SS-prME
TSLCLMMILPAALAFHLTSRDGEPRMIVGKNERGKSLLFKTASGTNMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAVLPEEQDQNYVCKHTYVDRGWGNGCGLFGKGSLVTCAKFQCLEPIEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDVPCKIPFSTEDGQGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSASRAWNVWEVEDYGFGVFTTNIWLKLREVYTQLCDHRLMSAAVKDERAVHADMGYWIESQKNGSWKLEKASLIEVKTCTWPKSHTLWSNGVLESDMIIPKSLAGPISQHNYRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGEVDNFTMGVLCLAILFEEVMRGKFGKKHMIAGVFFTFVLLLSGQITWRDMAHTLIMIGSNASDRMGMGVTYLALIATFKIQPFLALGFFLRKLTSRENLLLGVGLAMATTLQLPEDIEQMANGIALGLMALKLITQFETYQLWTALISLTCSNTIFTLTVAWRTATLILAGVSLLPVCQSSSMRKTDWLPMTVAAMGVPPLPLFIFTLKDTLKRRSWPLNEGVMAVGLVSILASSLLRNDVPMAGPLVAGGLLIACYVITGTSADLTVEKAADVTWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTHNGKRLEPNWASVKKDLISYGGGWRLSAQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKDFAAGRKSIALDLVTEIGRVPTHLAHRTRNALDNLVMLHTSEHGGKAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVASVNMVSRLLLNRFTMTHRRPTIEKDVDLGAGTRHVNAEPETPNMDVIGERIKRIKEEHNSTWHYDDENPYRTWAYHGSYEVKATGSASSMINGVVKLLTKPWDVVPMVTQMAMTDTTPFGQQRVFKEKVDTRTPRSMPGTRRVMGITAEWLWRTLGRNKKPRLCTREEFTKKVRTNAAMGAVFTEENQWDSAKAAVEDEDFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPTGTVMDIISRKDQRGSGQVGTYGLNTFTNMEAQLIRQMEGEGVLSKADLENPHLPEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLRETACLGKAYAQMWSLMYFHRRDLRLASNAICSAVPVHWVPTSRTTWSIHAHHQWMTTEDMLTVWNRVWIEDNPWMEDKTPVTTWENVPYLGKREDQWCGSLIGLTSRATWAQNIPTAIQQVRSLIGNEEFLDYMPSMKRFRKEEESEGAIW

SEQ ID NO: 5025 - protein, 3290 aa, Artificial Sequence
  derived and/or modified protein sequence (wt) from DENV-3__EU482452__SS-prME
TSLCLMMMLPATLAFHLTSRDGEPRMIVGKNERGKSLLFKTASGINMCTLIAMDLGEMCDDTVTYKCPLIAEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAILPEEQDQNYVCKHTYVDRGWGNGCGLFGKGSLVTCAKFQCLEPIEGKVVQYENLKYTVIITVHTGDQHQVGNDTQGVTVEITPQASTVEAVLPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCLDTFVLKKEVSETQHGTILIKVEYKGEDAPCKIPFSTEDGQGKAHNGRLITANPVVTKKEEPVNIEAEPPFGESNIVIGIGDKALKINWYKKGSSIGKMFEATARGARRMAILGDTAWDFGSVGGVLNSLGKMVHQIFGSAYTALFSGVSWIMKIGIGVLLTWIGLNSKNTSMSFSCIVIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDVIGVLEQGKRTLTPQPMELKYSWKTWGKAKIVTAETQNSSFIIDGLNTPECPSASRAWNVWEVEDYGFGVFTTNIWLKLREVYTQSCDHRLMSAAIKDERAVHADMGYWIESQKNGSWKLEKASFIEVKTCTWPKSHTLWSNGVLESDMIIPKSLAGPISQHNHRPGYHTQTAGPWHLGKLELDFNYCEGTTVVITENCGTRGPSLRTTTVSGKLIHEWCCRSCTLPPLRYMGEDGCWYGMEIRPINEKEENMVKSLVSAGSGKVDNFTMGVLCLAILFEEVMRGKFGKKHMIAGVLFTFVLLLSGQITWRDMAHTLIMIGSNASDRMGMGVTYLALIATFKIQPFLALGFFLRKLTSRENLLLGVGLAMATTLQLPEDIEQMANGIALGLMTLKLITQFETYQLWTALVSLTCSNTIFTLTVAWRTATLILAGVSLLPLCQSSSMRKTDWLPMTVAAMGVSPLPLFIFSLKDTPKRRSWPLNEGVMAVGLVSILASSLLRNDVPMAGPLVAGGLLIACYVITGTSADLTVEKAADVTWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTHNGKRLEPNWASVKKDLISYGGGWRLSAQWQKGEEVQVIAVEPGKNPKNFQTMPGIFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTAEAFPQSNAPIQDEERDIPERSWNSGNEWITDFVGKTVWFVPSIKAGNDIANCLRKNGKKVIQLSRKTFDTEYQKTRLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGERNNQILEENMDVEIWTKEGERKKLRPRWLDARTYSDPLALKEFKDFAAGRKSIALDLVTEIGRVPSHLAYRTRNALDNLVMLHTSEHGGRAYRHAVEELPETMETLLLLGLMILLTGGAMLFLISGKGIGKTSIGLICVIVSSGMLWMADIPLQWIASAIVLEFFMMVLLIPEPEKQRTPQDNQLAYVVIGILTLAAIVAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLVTHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGRRGTGSQGETLGEKWKKKLNQLSRKEFDLYKKSGITEVDRTEAKEGLKRGETTHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKYGGMLVRNPLSRNSTHEMYWISNGTGNIVSSVNMVSRLLLNRFTMTHRRPTIEKDVDLGAGTRHVNAEPETPNMDVIGERIKRIKEEHSSTWHYDDENPYKTWAYHGSYEVKATGSASSMINGVVKLLTKPWDVVPMVTQMAMTDTTPFGQQRVFKEKVDTRTPRPMPGTRKVMEITAEWLWRTLGRNKKPRLCTREEFTKKVRTNAAMGAVFTEENQWDSARAAVEDEEFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPKGTVMDIISRKDQRGSGQVGTYGLNTFTNMEAQLVRQMEGEGVLSKADLENPHLLEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLKETACLGKAYAQMWSLMYFHRRDLRLASNAICSAVPVHWIPTSRTTWSIHAHHQWMTTEDMLTVWNRVWIEDNPWMEDKTPVTTWEDVPYLGKREDQWCGSLIGLTSRATWAQNILTAIQQVRSLIGDEEFLDYMPSMKRFRKEEESEGAIW

SEQ ID NO: 5026 - protein, 3290 aa, Artificial Sequence
  derived and/or modified protein sequence (wt) from DENV-3__EU482453__SS-prME
TSLCLIMMLPATLAFHLTSRDGEPRMIVGKNERGKSLLFKTASGINMCTLIAMDLGEMCDDTVTYKCPLIAEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAILPEEQDQNYVCKHTYVDRGWGNGCGLFGKGSLVTCAKFQCLEPIEGKVVQYENLKYTVIITVHTGDQHQVGNDTQGVTVEITPQASTVEAVLPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCLNTFVLKKEVSETQHGTILIKVEYKGEDAPCKIPFSTEDGQGKAHNGRLITANPVVTKKEEPVNIEAEPPFGESNIVIGIGDKALKINWYKKGSSIGKMFEATARGARRMAILGDTAWDFGSVGGVLNSLGKMVHQIFGSAYTALFSGVSWIMKIGIGVLLTWIGLNSKNTSMSFSCIAIGIITLYLGAVVQADMGCAINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSASRAWNVWEVEDYGFGVFTTNIWLKLREVYTQSCDHRLMSAAIKDERAVHADMGYWIESQKNGSWKLEKASFIEVKTCTWPKSHTLWSNGVLESDMIIPKSLAGPISQHNHRPGYHTQTAGPWHLGKLELDFNYCEGTTVVITENCGTRGPSLRTTTVSGKLIHEWCCRSCTLPPLRYMGEDGCWYGMEIRPTNEKEENMVKSLVSAGSGKVDNFTMGVLCLAILFEEVMRGKFGKKHMIAGVLFTFVLLLSGQITWRDMAHTLIMIGSNASDRMGMGVTYLALIATFKIQPFLALGFFLRKLTSRENLLLGVGLAMATTLQLPEDIEQMANGIALGLMTLKLITQFETYQLWTALVSLTCSNTIFTLTVAWRTATLILAGVSLLPLCQSSSMRKTDWLPMTVAAMGVPPLPLFIFSLKDTPKRRSWPLNEGVMAVGLVSILASSLLRNDVPMAGPLVAGGLLIACYVITGTSADLTVEKAADVTWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTHNGKRLEPNWASVKKDLISYGGGWRLSAQWQKGEEVQVIAVEPGKNPKNFQTMPGIFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTAEAFPQSNAPIQDEERDIPERSWNSGNEWITDFVGKTVWFVPSIKAGNDIANCLRKNGKKVIQLSRKTFDTEYQKTRLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGERNNQILEENMDVEIWTKEGERKKLRPRWLDARTYSDPLALKEFKDFAAGRKSIALDLVTEIGRVPSHLAYRTRNALDNLVMLHTSEHGGRAYRHAVEELPETMETLLLLGLMILLTGGAMLFLISGKGIGKTSIGLICVIVSSGMLWMADVPLQWIASAIVLEFFMMVLLIPEPEKQRTPQDNQLAYVVIGILTLAAIVAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLVTHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGRRGTGSQGETLGEKWKKKLNQLSRKEFDLYKKSGITEVDRTEAKEGLKRGETTHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKYGGMLVRNPLSRNSTHEMYWISNGTGNIVSSVNMVSRLLLNRFTMTHRRPTIEKDVDLGAGTRHVNAEPETPNMDVIGERIKRIKEEHSSTWHYDDENPYKTWAYHGSYEVKATGSASSMINGVVKLLTKPWDVVPMVTQMAMTDTTPFGQQRVFKEKVDTRTPRPMPGTRKVMEITAEWLWRTLGRNKKPRLCTREEFTKKVRTNAAMGAVFTEENQWDSARAAVEDEEFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPKGTVMDIISRKDQRGSGQVGTYGLNTFTNMEAQLVRQMEGEGVLSKADLENPHLLEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLKETACLGKAYAQMWSLMYFHRRDLRLASNAICSAVPVHWIPTSRTTWSIHAHHQWMTTEDMLTVWNRVWIEDNPWMEDKTPVTTWEDVPYLGKREDQWCGSLIGLTSRATWAQNILTAIQQVRSLIGDEEFLDYMPSMKRFRKEEELEGAIW

SEQ ID NO: 5027 - protein, 3290 aa, Artificial Sequence
  derived and/or modified protein sequence (wt) from DENV-3__EU482454__SS-prME
TSLCLMMMLPATLAFHLTSRDGEPRMIVGKNERGKSLLFKTASGINMCTLIAMDLGEMCDDTVTYKCPLIAEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEATLPEEQDQNYVCKHTYVDRGWGNGCGLFGKGSLVTCAKFQCLEPIEGKVVQYENLKYTVIITVHTGDQHQVGNDTQGVTVEITPQASTVEAVLPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCLNTFVLKKEVSETQHGTILIKVEYKGEDAPCKIPFSTEDGQGKAHNGRLITANPVVTKKEEPVNIEAEPPFGESNIVIGIGDKALKINWYKKGSSIGKMFEATAKGARRMAILGDTAWDFGSVGGVLNSLGKMVHQIFGSAYTALFSGVSWIMKIGIGVLLTWIGLNSKNTSMSFSCIVIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSASRAWNVWEVEDYGFGVFTTNIWLKLREVYTQSCDHRLMSAAIKDERAVHADMGYWIESQKNGSWKLEKASFIEVKTCTWPKSHTLWSNGVLESDMIIPKSLAGPISQHNHRPGYHTQTAGPWHLGKLELDFNYCEGTTVVITENCGTRGPSLRTTTVSGKLIHEWCCRSCTLPPLRYMGEDGCWYGMEIRPINEKEENMVKSLVSAGSGKVDNFTMGVLCLAILFEEVMRGKFGKKHMIAGVLFTFVLLLSGQITWRDMAHTLIMIGSNASDRMGMGVTYLALIATFKIQPFLALGFFLRKLTSRENLLLGVGLAMATTLQLPEDIEQMANGIALGLMTLKLITQFETYQLWTALVSLTCSNTIFTLTVAWRTATLILAGVSLLPLCQSSSMRKTDWLPMTVAAMGVPPLPLFIFSLKDTPKRRSWPLNEGVMAVGLVSILASSLLRNDVPMAGPLVAGGLLIACYVITGTSADLTVEKAADVTWVEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQREGVFHTMWHVTRGAVLTHNGKRLEPNWASVKKDLISYGGGWRLSAQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTAEAFPQSNAPIQDEERDIPERSWNSGNEWITDFVGKTVWFVPSIKAGNDIANCLRKNGKKVIQLSRKTFDTEYQKTRLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGERNNQILEENMDVEIWTKEGERKKLRPRWLDARTYSDPLALKEFKDFAAGRKSIALDLVTEIGRVPSHLAHRTRNALDNLVMLHKSEHGGRAYRHAVEELPETMETLLLLGLMILLTGGAMLFLISGKGIGKTSMGLICVIVSSGMLWMADVPLQWIASAIVLEFFMMVLLIPEPEKQRTPQDNQLAYVVIGILTLAAIVAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLVTHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGRRGTGSQGETLGEKWKKKLNQLSRKEFDLYKKSGITEVDRTEAKEGLKRGETTHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKYGGMLVRNPLSRNSTHEMYWISNGTGNIVSSVNMVSRLLLNRFTMTHRRPTIEKDVDLGAGTRHVNAEPETPNMDVIGERIKRIKEEHSSTWHYDDENPYKTWAYHGSYEVKATGSASSMINGVVKLLTKPWDVVPMVTQMAMTDTTPFGQQRVFKEKVDTRTPRPMPGTRKVMEITAEWLWRTLGRNKKPRLCTREEFTKKVRTNAAMGAVFTEENQWDSARAAVEDEEFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPKGTVMDIISRKDQRGSGQVGTYGLNTFTNMEAQLVRQMEGEGVLSKADLENPHLLEKRITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLKETACLGKAYAQMWSLMYFHRRDLRLASNAICSAVPAHWIPTSRTTWSIHAHHQWMTTEDMLTVWNRVWIEDNPWMEDKTPVTTWEDVPYLGKREDQWCGSLIGLTSRATWAQNILTAIQQVRSLIGDEEFLDYMPSMKRFRKEEESEGAIW

SEQ ID NO: 5028 - protein, 3290 aa, Artificial Sequence
  derived and/or modified protein sequence (wt) from DENV-3__EU482455__SS-prME
TSLCLMMMLPATLAFHLTSRDGEPRMIVGKNERGKSLLFKTASGINMCTLIAMDLGEMCDDTVTYKCPLVAEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAILPEEQDQNYVCKHTYVDRGWGNGCGLFGKGSLVTCAKFQCLEPIEGKVVQYENLKYTVIITVHTGDQHQVGNDTQGVTVEITPQASTVEAVLPEYGTLGLECSPRTGLDFNEMILLTMKNKAWMVHRQWFFDLPLPWTSGATTETPTWNKKELLVTFKNAHAKKQEVVVLGSQEGAMHTALTGATEIQNSGGTSIFAGHLKCRLKMDKLELKGMSYAMCLNTFVLKKEVSETQHGTILIKVEYKGEDAPCKIPFSTEDGQGKAHNGRLITANPVVTKKEEPVNIEAEPPFGESNIVIGIGDKALKINWYKKGSSIGKMFEATARGARRMAILGDTAWDFGSVGGVLNSLGKMVHQIFGSAYTALFSGVSWIMKIGIGVLLTWIGLNSKNTSMSFSCIVIGIITLYLGAVVQADMGCAINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSASRAWNVWEVEDYGFGVFTTNIWLKLREVYTQSCDHRLMSAAIKDERAVHADMGYWIESQKNGSWKLEKASFIEVKTCTWPKSHTLWSNGVLESDMIIPKSLAGPISQHNHRPGYHTQTAGPWHLGKLELDFNYCEGTTVVITENCGTRGPSLRTTTVSGKLIHEWCCRSCTLPPLRYMGEDGCWYGMEIRPINEKEENMVKSLVSAGSGKVDNFTMGVLCLAILFEEVMRGKFGKKHMIAGVLFTFVLLLSGQITWRDMAHTLIMIGSNASDRMGMGVTYLALIATFKIQPFLALGFFLRKLTSRENLLLGVGLAMATTLQLPEDIEQMANGIALGLMTLKLITQFETYQLWTALVSLTCSNTIFTLTVAWRTATLILAGVSLLPLCQSSSMRKTDWLPMTVAAMGVPPLPLFIFSLKDTPKRRSWPLNEGVMAVGLVSILASSLLRNDVPMAGPLVAGGLLIACYVITGTSADLTVEKAADVTWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTHNGKRLEPNWASVKKDLISYGGGWRLSAQWQKGEEVQVIAVEPGKNPKNFQTMPGIFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTAEAFPQSNAPIQDEERDIPERSWNSGNEWITDFVGKTVWFVPSIKAGNDIANCLRKNGKKVIQLSRKTFDTEYQKTRLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGERNNQILEENMDVEIWTKEGERKKLRPRWLDARTYSDPLALKEFKDFAAGRKSIAFDLVTEIGRVPSHLAYRTRNALDNLVMLHTSEHGGRAYRHAVEELPETMETLLLLGLMILLTGGAMLFLISGKGIGKTSIGLICVIVSSGMLWMADVPLQWIASAIVLEFFMMVLLIPEPEKQRTPQDNQLAYVVIGILTLAAIVAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLVTHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGIGRRGTGSQGETLGEKWKKKLNQLSRKEFDLYKKSGITEVDRTEAKEGLKRGETTHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKYGGMLVRNPLSRNSTHEMYWISNGTGNIVSSVNMVSRLLLNRFTMTHRRPTIEKDVDLGAGTRHVNAEPETPNMDVIGERIKRIKEEHSSTWHYDDENPYKTWAYHGSYEVKATGSASSMINGVVKLLTKPWDVVPMVTQMAMTDTTPFGQQRVFKEKVDTRTPRPMPGTRKVMEITAEWLWRTLGRNKKPRLCTREEFTKKVRTNAAMGAVFTEENQWDSARAAVEDEEFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPKGTVMDIISRKDQRGSGQVGTYGLNTFTNMEAQLVRQMEGEGVLSKADLENPHLLEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLKETACLGKAYAQMWSLMYFHRRDLRLASNAICSAVPVHWIPTSRTTWSIHAHHQWMTTEDMLTVWNRVWIEDNPWMEDKTPVTTWEDVPYLGKREDQWCGSLIGLTSRATWAQNILTAIQQVRSLIGDEEFLDYMPSMKRFRKEEESEGAIW

SEQ ID NO: 5029 - protein, 3290 aa, Artificial Sequence
  derived and/or modified protein sequence (wt) from DENV-3__EU482456__SS-prME
TSLCLMMMLPATLAFHLTSRDGEPRMIVGKNERGKSLLFKTASGINMCTLIAMDLGEMCDDTVTYKCPLIAEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAILPEEQDQNYVCKHTYVDRGWGNGCGLFGKGSLVTCAKFQCLEPIEGKVVQYENLKYTVIITVHTGDQHQVGNDTQGVTVEITPQASTVEAVLPEYGTLGLECSPRTGLDFTEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCLNTFVLKKEVSETQHGTILIKVEYKGEDAPCKIPFSTEDGQGKAHNGRLITANPVVTKKEEPVNIEAEPPFGESNIVIGIGDKALKINWYKKGSSIGKMFEATARGARRMAILGDTAWDFGSVGGVLNSLGKMVHQIFGSAYTALFSGVSWIMKIGIGVLLTWIGLNSKNTSMSFSCIVIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDTIGVLEQGKRTLTPQPMELKYSWKTWGKAKIVTAETQNSSFIIDGPNTPECPSASRAWNVWEVEDYGFGVFTTNIWLKLREVYTQSCDHRLMSAAIKDERAVHADMGYWIESQKNGSWKLEKASFIEVKTCTWPKSHTLWSNGVLESDMIIPKSLAGPISQHNHRPGYHTQTAGPWHLGKLELDFNYCEGTTVVITENCGTRGPSLRTTTVSGKLIHEWCCRSCTLPPLRYMGEDGCWYGMEIRPINEKEENMVKSLVSAGSGKVDNFTMGVLCLAILFEEVMRGKFGKKHMIAGVLFTFVLLLSGQITWRDMAHTLIMIGSNASDRMGMGVTYLALIATFKIQPFLALGFFLRKLTSRENLLLGVGLAMATTLQLPEDIEQMANGIALGLMTLKLITQFETYQLWTALVSLTCSNTIFTLTVAWRTATLILAGVSLLPLCQSSSMRKTDWLPMTVAAMGVPPLPLFIFSLKDTPKRRSWPLNEGVMAVGLVSILASSLLRNDVPMAGPLVAGGLLIACYVITGTSADLTVEKAADVTWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTHNGKRLEPNWASVKKDLISYGGGWRLSAQWQKGEEVQVIAVEPGKNPKNFQTMPGIFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTAEAFPQSNAPIQDEERDIPERSWNSGNEWITDFVGKTVWFVPSIKAGNDIANCLRKNGKKVIQLSRKTFDTEYQKTRLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGERNNQILEENMDVEIWTKEGERKKLRPRWLDARTYSDPLALKEFKDFAAGRKSIALDLVTEIGRVPSHLAYRTRNALDNLVMLHTSEHGGRAYRHAVEELPETMETLLLLGLMILLTGGAMLFLISGKGIGKTSIGLICVIVSSGMLWMADVPLQWIASAIVLEFFMMVLLIPEPEKQRTPQDNQLAYVVIGILTLAAIVAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLVTHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGRRGTGSQGETLGEKWKKKLNQLSRKEFDLYKKSGITEVDRTEAKEGLKRGETTHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKYGGMLVRNPLSRNSTHEMYWISNGTGNIVSSVNMVSRLLLNRFTMTHRRPTIEKDVDLGAGTRHVNAEPETPNMDVIGERIKRIKEEHSSTWHYDDENPYKTWAYHGSYEVKATGSASSMINGVVKLLTKPWDVVPMVTQMAMTDTTPFGQQRVFKEKVDTRTPRPMPGTRKVMEITAEWLWRTLGRNKKPRLCTREEFTKKVRTNAAMGAVFTEENQWDSARAAVEDEEFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPKGTVMDIISRKDQRGSGQVGTYGLNTFTNMEAQLVRQMEGEGVLSKADLENPHLLEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLKETACLGKAYAQMWSLMYFHRRDLRLASNAICSAVPVHWIPTSRTTWSIHAHHQWMTTEDMLTVWNRVWIEDNPWMEDKTPVTTWEDVPYLGKREDQWCGSLIGLTSRATWAQNILTAIQQVRSLIGDEEFLDYMPSMKRFRKEEESEGAIW

SEQ ID NO: 5030 - protein, 3290 aa, Artificial Sequence
  derived and/or modified protein sequence (wt) from DENV-3__EU482457__SS-prME
TSFCLMMMLPATLAFHLTSRDGEPRMIVGKNERGKSLLFKTASGINMCTLIAMDLGEMCDDTVTYKCPLIAEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEATLPEEQDQNYVCKHTYVDRGWGNGCGLFGKGSLVTCAKFQCLEPIEGKVVQYENLKYTVIITVHTGDQHQVGNDTQGVTVEITPQASTVEAVLPEYGILGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDRLELKGMSYAMCLNTFVLKKEVSETQHGTILIKVEYKGEDAPCKIPFSTEDGQGKAHNGRLITANPVVTKKEEPVNIEAEPPFGESNIVIGIGDKALKINWYKKGSSIGKMFEATARGARRMAILGDTAWDFGSVGGVLNSLGKMVHQIFGSAYTALFSGVSWIMKIGIGVLLTWIGLNSKNTSMSFSCIVIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDTIGVLEQGKRTLTPQPMELKYSWKTWGKAKIVTAETQNSSFIIDGPNTPECPSASRAWNVWEVEDYGFGVFTTNIWLKLREVYTQSCDHRLMSAAIKDERAVHADMGYWIESQKNGSWKLEKASFIEVKTCTWPKSHTLWSNGVLESDMIIPKSLAGPISQHNHRPGYHTQTAGPWHLGKLELDFNYCEGTTVVITENCGTRGPSLRTTTVSGKLIHEWCCRSCTLPPLRYMGEDGCWYGMEIRPINEKEENMVKSLVSAGSGKVDNFTMGVLCLAILFEEVMRGKFGKKHMIAGVLFTFVLLLSGQITWRDMAHTLIMIGSNASDRMGMGVTYLALIATFKIQPFLALGFFLRKLTSRENLLLGVGLAMATTLQLPEDIEQMANGIALGLMTLKLITQFETYQLWTALVSLTCSNTIFTLTVAWRTATLILAGVSLLPLCQSSSMRKTDWLPMTVAAMGVPPLPLFIFSLKDTPKRRSWPLNEGVMAVGLVSILASSLLRNDVPMAGPLVAGGLLIACYVITGTSADLTVEKAADVTWEEEAEQTGVSHNLMVTVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTHNGKRLEPNWASVKKDLISYGGGWRLSAQWQKGEEVQVIAVEPGKNPKNFQTMPGIFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTAEAFPQSNAPIQDEERDIPERSWNSGNEWITDFVGKTVWFVPSIKAGNDIANCLRKNGKKVIQLSRKTFDTEYQKTRLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFGPEREKSAAIDGEYRLKGESRKTFVELMRRGDLPVWLAYKVASEGIKYTDRKWCFDGERNNQILEENMDVEIWTKEGERKKLRPRWLDARTYSDPLALKEFKDFAAGRKSIALDLVTEIGRVPSHLAHRTRNALDNLVMLHTSEHGGRAYRHAVEELPETMETLLLLGLMILLTGGAMLFLISGKGIGKTSIGLICVIVSSGMLWMADVPLQWIASAIVLEFFMMVLLIPEPEKQRTPQDNQLAYVVIGILTLAAIVAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLVTHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGRRGTGSQGETLGEKWKKKLNQLSRKEFDLYKKSGITEVDRTEAKEGLKRGETTHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKYGGMLVRNPLSRNSTHEMYWISNGTGNIVSSVNMVSRLLLNRFTMTHRRPTIEKDVDLGAGTRHVNAEPETPNMDVIGERIKRIKEEHSSTWHYDDENPYKTWAYHGSYEVKATGSASSMINGVVKLLTKPWDVVPMVTQMAMTDTTPFGQQRVFKEKVDTRTPRPMPGTRKVMEITAEWLWRTLGRNKKPRLCTREEFTKKVRTNAAMGAVFTEENQWDNARAAVEDEEFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPKGTVMDIISRKDQRGSGQVGTYGLNTFTNMEAQLVRQMEGEGVLSKADLENPHLLEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLKETACLGKAYAQMWSLMYFHRRDLRLASNAICSAVPVHWIPTSRTTWSIHAHHQWMTTEDMLTVWNRVWIEDNPWMEDKTPVTTWEDVPYLGKREDQWCGSLIGLTSRATWAQNILTAIQQVRSLIGDEEFLDYMPSMKRFRKEEESEGAIW

SEQ ID NO: 5031 - protein, 3290 aa, Artificial Sequence
  derived and/or modified protein sequence (wt) from DENV-3__EU482458__SS-prME
TSLCLMMMLPATLAFHLTSRDGEPRMIVGKNERGKSLLFKTASGINMCTLIAMDLGEMCDDTVTYKCPLIAEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAILPEEQDQNYVCKHTYVDRGWGNGCGLFGKGSLVTCAKFQCLEPIEGKVVQYENLKYTVIITVHTGDQHQVGNDTQGVTVEITPQASTVEAVLPEYGTLGLECSPRTGLDFNEMILLTMKNKAWMVHRQWFFDLPLPWTSGATTETPTWNRKELLTTFKNAHAKKQEVVVLGSQEGAMHTALTGATEIQNSGGTSIFAGHLKCRLKMDKLELKGMSYAMCLNTFVLKKEVSETQHGTILIKVEYKGEDAPCKIPFSTEDGQGKAHNGRLITANPVVTKKEEPVNIEAEPPFGESNIVIGIGDKALKINWYKKGSSIGKMFEATARGARRMAILGDTAWDFGSVGGVLNSLGKMVHQIFGSAYTALFSGVSWIMKIGIGVLLTWIGLNSKNTSMSFSCIVIGIITLYLGAVVQADMGCAINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSASRAWNVWEVEDYGFGVFTTNIWLKLREVYTQSCDHRLMSAAIKDERAVHADMGYWIESQKNGSWKLEKASFIEVKTCTWPKSHTLWSNGVLESDMIIPKSLAGPISQHNHRPGYHTQTAGPWHLGKLELDFNYCEGTTVVITENCGMRGPSLRTTTVSGKLIHEWCCRSCTLPPLRYMGEDGCWYGMEIRPINEKEENMVKSLVSAGSGKVDNFTMGVLCLAILFEEVMRGKFGKKHMIAGVLFTFVLLLSGQITWRDMAHTLIMIGSNASDRMGMGVTYLALIATFKIQPFLALGFFLRKLTSRENLLLGVGLAMATTLQLPEDIEQMANGIALGLMTLKLITQFETYQLWTALVSLTCSNTIFTLTVAWRTATLILAGVSLLPLCQSSSMRKTDWLPMTVAAMGVPPLPLFIFSLKDTPKRRSWPLNEGVMAVGLVSILASSLLRNDVPMAGPLVAGGLLIACYVITGTSADLTVEKAADVTWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTHNGKRLEPNWASVKKDLISYGGGWRLSAQWQKGEEVQVIAVEPGKNPKNFQTMPGIFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTAEAFPQSNAPIQDEERDIPERSWNSGNEWITDFVGKTVWFVPSIKAGNDIANCLRKNGKKVIQLSRKTFDTEYQKTRLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGERNNQILEENMDVEIWTKEGERKKLRPRWLDARTYSDPLALKEFKDFAAGRKSIALDLVTEIGRVPSHLAYRTRNALDNLVMLHTSEHGGRAYRHAVEELPETMETLLLLGLMILLTGGAMLFLISGKGIGKTSIGLICVIVSSGMLWMADVPLQWIASAIVLEFFMMVLLIPEPEKQRTPQDNQLAYVVIGILTLAAIVAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLVTHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGRRGTGSQGETLGEKWKKKLNQLSRKEFDLYKKSGITEVDRTEAKEGLKRGETTHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKYGGMLVRNPLSRNSTHEMYWISNGTGNIVSSVNMVSRLLLNRFTMTHRRPTIEKDVDLGAGTRHVNAEPETPNMDVIGERIKRIKEEHSSTWHYDDENPYKTWAYHGSYEVKATGSASSMINGVVKLLTKPWDVVPMVTQMAMTDTTPFGQQRVFKEKVDTRTPRPMPGTRKVMEITAEWLWRTLGRNKKPRLCTREEFTKKVRTNAAMGAVFTEENQWDSARAAVEDEEFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPKGTVMDIISRKDQRGSGQVGTYGLNTFTNMEAQLVRQMEGEGVLSKADLENPHLLEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLKETACLGKAYAQMWSLMYFHRRDLRLASNAICSAVPVHWIPTSRTTWSIHAHHQWMTTEDMLTVWNRVWIEDNPWMEDKTPITTWEDVPYLGKREDQWCGSLIGLTSRATWAQNILTAIQQVRSLIGDEEFLDYMPSMKRFRKEEESEGAIW

SEQ ID NO: 5032 - protein, 3290 aa, Artificial Sequence
  derived and/or modified protein sequence (wt) from DENV-3__EU482459__SS-prME
TSLCLMMMLPATLAFHLTSRDGEPRMIVGKNERGKSLLFKTASGINMCTLIAMDLGEMCDDTVTYKCPLIAEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAILPEEQDQNYVCKHTYVDRGWGNGCGLFGKGSLVTCAKFQCLEPIEGKVVQYENLKYTVIITVHTGDQHQVGNDTQGVTVEITPQASTVEAVLPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCLNTFVLKKEVSETQHGTILIKVEYKGEDAPCKIPFSTEDGQGKAHNGRLITANPVVTKKEEPVNIEAEPPFGESNIVIGIGDKALKINWYKKGSSIGKMFEATARGARRMAILGDTAWDFGSVGGVLNSLGKMVHQIFGSAYTALFSGVSWIMKIGIGVLLTWIGLNSKNTSMSFSCIVIGIITLYLGAVVQADMGCAINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSASRAWNVWEVEDYGFGVFTTNIWLKLREVYTQSCDHRLMSAAIKDERAVHADMGYWIESQKNGSWKLEKASFIEVKTCTWPKSHTLWSNGVLESDMIIPKSLAGPISQHNHRPGYHTQTAGPWHLGKLELDFNYCEGTTVVITENCGTRGPSLRTTTVSGKLIHEWCCRSCTLPPLRYMGEDGCWYGMEIRPINEKEENMVKSLVSAGSGKVDNFTMGVLCLAILFEEVMRGKFGKKHMIAGVLFTFVLLLSGQITWRDMAHTLIMIGSNASDRMGMGVTYLALIATFKIQPFLALGFFLRKLTSRENLLLGVGLAMATTLQLPEDIEQMANGIALGLMTLKLITQFETYQLWTALVSLTCSNTIFTLTVAWRTATLILAGVSLLPLCQSSSMRKTDWLPMTVAAMGVPPLPLFIFSLKDTPKRRSWPLNEGVMAVGLVSILASSLLRNDVPMAGPLVAGGLLIACYVITGTSADLTVEKAADVTWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTHNGKRLEPNWASVKKDLISYGGGWRLSAQWQKGEEVQVIAVEPGKNPKNFQTMPGIFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTAEAFPQSNAPIQDEERDIPERSWNSGNEWITDFVGKTVWFVPSIKAGNDIANCLRKNGKKVIQLSRKTFDTEYQKTRLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGERNNQILEENMDVEIWTKEGERKKLRPRWLDARTYSDPLALKEFKDFAAGRKSIALDLVTEIGRVPSHLAYRTRNALDNLVMLHTSEHGGRAYRHAVEELPETMETLLLLGLMILLTGGAMLFLISGKGIGKTSIGLICVIVSSGMLWMADVPLQWIASAIVLEFFMMVLLIPEPEKQRTPQDNQLAYVVIGILTLAAIVAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLVTHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGRRGTGSQGETLGEKWKKKLNQLSRKEFDLYKKSGITEVDRTEAKEGLKRGETTHHAVSRGSAKLQWFVERNMVIPEGRVIDLGCGRGGWSYYCAGLKKVTEVRGYTKGGPGHEEPVPMSTYGWNLVKLMSGKDVFYLPPEKCDTLLCDIGESSPSPTVEESRTIRVLKMVEPWLKNNQFCIKVLNPYMPTVIEHLERLQRKYGGMLVRNPLSRNSTHEMYWISNGTGNIVSSVNMVSRLLLNRFTMTHRRPTIEKDVDLGAGTRHVNAEPETPNMDVIGERIKRIKEEHSSTWHYDDENPYKTWAYHGSYEVKATGSASSMINGVVKLLTKPWDVVPMVTQMAMTDTTPFGQQRVFKEKVDTRTPRPMPGTRKVMEITAEWLWRTLGRNKKPRLCTREEFTKKVRTNAAMGAVFTEENQWDSARAAVEDEEFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPKGTVMDIISRKDQRGSGQVGTYGLNTFTNMEAQLVRQMEGEGVLSKADLENPHLLEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLKETACLGKAYAQMWSLMYFHRRDLRLASNAICSAVPVHWIPTSRTTWSIHAHHQWMTTEDMLTVWNRVWIEDNPWMEDKTPVTTWEDVPYLGKREDQWCGSLIGLTSRATWAQNILTAIQQVRSLIGDEEFLDYMPSMKRFRKEEESEGAIW

SEQ ID NO: 5033 - protein, 3290 aa, Artificial Sequence
  derived and/or modified protein sequence (wt) from DENV-3__EU482460__SS-prME
TSLCLMMMLPATFAFHLTSRDGEPRMIVGKNERGKSLLFKTASGINMCTLIAMDLGEMCDDTVTYKCPLIAEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAILPEEQDQNYVCKHTYVDRGWGNGCGLFGKGSLVTCAKFQCLEPIEGKVVQYENLKYTVIITVHTGDQHQVGNDTQGVTVEITPQASTVEAVLPEYGTLGLECSPRTGLDFNEMILLTMKNKAWMVHRQWFFDLPLPWTSGTTTETPTWNRKELLVTFKNAHAKKQEVVVLGSQEGAMHTALTGATEIQNSGGTSIFAGHLKCRLKMDKLELKGMSYAMCLNTFVLKKEVSETQHGTILIKVEYKGEDAPCKIPFSTEDGQGKAHNGRLITANPVVTKKEEPVNIEAEPPFGESNIVIGIGDKALKINWYKKGSSIGKMFEATARGARRMAILGDTAWDFGSVGGVLNSLGKMVHQIFGSAYTALFSGVSWIMKIGIGVLLTWIGLNSKNTSMSFSCIVIGIITLYLGAVVQADMGCAINWKGKELKCGSGIFVTNEVHTWTEQYRFQADSPKRLATAIAGAWENGVCGIRSTTRMENLLWKQIANELNYILWENNIKLTVVVGDIIGVLEQGKRALAPQPMELKYSWKTWGKAKIVTAETQNSSFIIDGPNTPECPSASRAWNVWEVEDYGFGVFTTNIWLKLREVYTQSCDHRLMSAAIKDERAVHADMGYWIESQKNGSWKLEKASFIEVKTCTWPKSHTLWSNGVLESDMIIPKSLAGPISQHNHRPGYHTQTAGPWHLGKLELDFNYCEGTTVVITENCGTRGPSLRTTTVSGKLIHEWCCRSCTLPPLRYMGEDGCWYGMEIRPINEKEENMVKSLVSAGSGKVDNFTMGVLCLAILFEEVMRGKFGKKHMIAGVLFTFVLLLSGQITWRDMAHTLIMIGSNASDRMGMGVTYLALIATFKIQPFLALGFFLRKLTSRENLLLGVGLAMATTLQLPEDIEQMANGIALGLMTLKLITQFETYQLWTALVSLTCSNTIFTLTVAWRTATLILAGVSLLPLCQSSSMRKTDWLPMTVAAMGVPPLPLFIFSLKDTPKRRSWPLNEGVMAVGLVSILASSLLRNDVPMAGPLVAGGLLIACYVITGTSADLTVEKAADVTWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTHNGKRLEPNWASVKKDLISYGGGWRLSAQWQKGEEVQVIAVEPGKNPKNFQTMPGIFQTTMGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTAEAFPQSNAPIQDEERDIPERSWNSGNEWITDFVGKTVWFVPSIKAGNDIANCLRKNGKKVIQLSRKTFDTEYQKTRLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGERNNQILEENMDVEIWTKEGERKKLRPRWLDARTYSDPLALKEFKDFAAGRKSIALDLVTEIGRVPSHLAYRTRNALDNLVMLHTSEHGGRAYRHAVEELPETMETLLLLGLMILLTGGAMLFLISGKGIGKTSIGLICVIVSSGMLWMADVPLQWIASAIVLEFFMMVLLIPEPEKQRTPQDNQLAYVVIGILTLAAIVAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLVTHYAIIGPGLQAKATREAQKRTAAGIMKNPTVDGIMTIDLDPVIYDPKFEKQLGQVMLLVLCAVQLLLMRTSWALCEALTLATGPITTLWEGSPGKFWNTTIAVSMANIFRGSYLAGAGLAFSIMKSVGTGRRGTGSQGETLGEKWKKKLNQLSRKEFDLYKKSGITEVDRTEAKEGLKRGETTHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKYGGMLVRNPLSRNSTHEMYWISNGTGNIVSSVNMVSRLLLNRFTMTHRRPTIEKDVDLGAGTRHVNAEPETPNMDVIGERIKRIKEEHSSTWHYDDENPYKTWAYHGSYEVKATGSASSMINGVVKLLTKPWDVVPMVTQMAMTDTTPFGQQRVFKEKVDTRTPRPMPGTRKVMEITAEWLWRTLGRNKKPRLCTREEFTKKVRTNAAMGAVFTEENQWDSARAAVEDEEFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPKGTVMDIISRKDQRGSGQVGTYGLNTFTNMEAQLVRQMEGEGVLSKADLENPHLLEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLKETACLGKAYAQMWSLMYFHRRDLRLASNAICSAVPVHWIPTSRTTWSIHAHHQWMTTEDMLTVWNRVWIEDNPWMEDKTPVTTWEDVPYLGKREDQWCGSLIGLTSRATWAQNILTAIQQVRSLIGDEEFLDYMPSMKRFRKEEESEGAIW

SEQ ID NO: 5034 - protein, 3290 aa, Artificial Sequence
  derived and/or modified protein sequence (wt) from DENV-3__EU482461__SS-prME
TSLCLMMMLPATLAFHLTSRDGEPRMIVGKNERGKSLLFKTASGINMCTLIAMDLGEMCDDTVTYKCPLIAEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAILPEEQDQNYVCKHTYVDRGWGNGCGLFGKGSLVTCAKFQCLEPIEGKVVQYENLKYTVIITVHTGDQHQVGNDTQGVTVEITPQASTVEAVLPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCLNTFVLKKEVSETQHGTILIKVEYKGEDAPCKIPFSTEDGQGKAHNGRLITANPVVTKKEEPVNIEAEPPFGESNIVIGIGDKALKINWYKKGSSIGKMFEATARGARRMAILGDTAWDFGSVGGVLNSLGKMVHQIFGSAYTALFSGVSWIMKIGIGVLLTWIGLNSKNTSMSFSCIVIGIITLYLGAVVQADMGCAINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSASRAWNVWEVEDYGFGVFTTNIWLKLREVYTQSCDHRLMSAAIKDERAVHADMGYWIESQKNGSWKLEKASFIEVKTCTWPKSHTLWSNGVLESDMIIPKSLAGPISQHNHRPGYHTQTAGPWHLGKLELDFNYCEGTTVVITENCGTRGPSLRTTTVSGKLIHEWCCRSCTLPPLRYMGEDGCWYGMEIRPINEKEENMVKSLVSAGSGKVDNFTMGVLCLAILFEEVMRGKFGKKHMIAGVLFTFVLLLSGQITWRDMAHTLIMIGSNASDRMGMGVTYLALIATFKIQPFLALGFFLRKLTSRENLLLGVGLAMATTLQLPEDIEQMANGIALGLMTLKLITQFETYQLWTALVSLTCSNTIFTLTVAWRTATLILAGVSLLPLCQSSSMRKTDWLPMTVAAMGVPPLPLFIFSLKDTPKRRSWPLNEGVMAVGLVSILASSLLRNDVPMAGPLVAGGLLIACYVITGTSADLTVEKAADVTWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTHNGKRLEPNWASVKKDLISYGGGWRLSAQWQKGEEVQVIAVEPGKNPKNFQTMPGIFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLVIMDEAHFTDPASIAARGYISTRVGMGEAAAIFMTATPPGTAEAFPQSNAPIQDEERDIPERSWNSGNEWITDFVGKTVWFVPSIKAGNDIANCLRKNGKKVIQLSRKTFDTEYQKTRLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGERNNQILEENMDVEIWTKEGERKKLRPRWLDARTYSDPLALKEFKDFAAGRKSIALDLVTEIGRVPSHLAYRTRNALDNLVMLHTSEHGGRAYRHAVEELPETMETLLLLGLMILLTGGAMLFLISGKGIGKTSIGLICVIVSSGMLWMADVPLQWIASAIVLEFFMMVLLIPEPEKQRTPQDNQLAYVVIGILTLAAIVAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLVTHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGRRGTGSQGETLGEKWKKKLNQLSRKEFDLYKKSGITEVDRTEAKEGLKRGETTHHAVSRGSAKLQWFVERNMVIPEGRVIDLGCGRGGWSYYCAGLKKVTEVRGYTKGGPGHEEPVPMSTYGWNLVKLMSGKDVFYLPPEKCDTLLCDIGESSPSPTVEESRTIRVLKMVEPWLKNNQFCIKVLNPYMPTVIEHLERLQRKYGGMLVRNPLSRNSTHEMYWISNGTGNIVSSVNMVSRLLLNRFTMTHRRPTIEKDVDLGAGTRHVNAEPETPNMDVIGERIKRIKEEHSSTWHYDDENPYKTWAYHGSYEVKATGSASSMINGVVKLLTKPWDVVPMVTQMAMTDTTPFGQQRVFKEKVDTRTPRPMPGTRKVMEITAEWLWRTLGRNKKPRLCTREEFTKKVRTNAAMGAVFTEENQWDSARAAVEDEEFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPKGTVMDIISRKDQRGSGQVGTYGLNTFTNMEAQLVRQMEGEGVLSKADLENPHLLEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLKETACLGKAYAQMWSLMYFHRRDLRLASNAICSAVPVHWIPTSRTTWSIHAHHQWMTTEDMLTVWNRVWIEDNPWMEDKTPVTTWEDVPYLGKREDQWCGSLIGLTSRATWAQNILTAIQQVRSLIGDEEFLDYMPSMKRFRKEEESEGAIW

SEQ ID NO: 5035 - protein, 3290 aa, Artificial Sequence
  derived and/or modified protein sequence (wt) from DENV-3__EU482462__SS-prME
TSLCLMMMLPATLAFHLTSRDGEPRMIVGKNERGKSLLFKTASGINMCTLIAMDLGEMCDDTVTYKCPLIAEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMARNKPTLDIELQKTEATQLATLRKLCIEGKITNITTDSRCPTQGEAILPEEQDQNYVCKHTYVDRGWGNGCGLFGKGSLVTCAKFQCLEPIEGKVVQYENLKYTVIITVHTGDQHQVGNDTQGVTVEITPQASTVEAVLPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCLNTFVLKKEVSETQHGTILIKVEYKGEDAPCKIPFSTEDGQGKAHNGRLITANPVVTKKEEPVNIEAEPPFGESNIVIGIGDKALKINWYKKGSSIGKMFEATARGARRMAILGDTAWDFGSVGGVLNSLGKMVHQIFGSAYTALFSGVSWIMKIGIGVLLTWIGLNSKNTSMSFSCIVIGIITLYLGAVVQADMGCAINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMDLKYSWKTWGKAKIVTAETQNSSFIIDGPNTPECPSASRAWNVWEVEDYGFGVFTTNIWLKLREVYTQSCDHRLMSAAIKDERAVHADMGYWIESQKNGSWKLEKASFIEVKTCTWPKSHTLWSNGVLESDMIIPKSLAGPISQHNHRPGYHTQTAGPWHLGKLELDFNYCEGTTVVITENCGTRGPSLRTTTVSGKLIHEWCCRSCTLPPLRYMGEDGCWYGMEIRPINEKEENMVKSLVSAGSGKVDNFTMGVLCLAILFEEVMRGKFGKKHMIAGVLFTFVLLLSGQITWKDMAHTFIMIGSNASDRMGMGVTYLALIATFKIQPFLALGFFLRKLTSRENLLLGVGLAMATTLQLPEDIEQMANGIALGLMTLKLITQFETYQLWTALVSLTCSNTIFTLTVAWRTATLVLAGVSLLPLCQSSSMRKTDWLPMTVAAMGVPPLPLFIFSLKDTPKRRSWPLNEGVMAVGLVSILASSLLRNDVPMAGPLVAGGLLIACYVITGTSADLTVEKAADVTWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTHNGKRLEPNWASVKKDLISYGGGWRLSAQWQKGEEVQVIAVEPGKNPKNFQTMPGIFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTAEAFPQSNAPIQDEERDIPERSWNSGNEWITDFVGKTVWFVPSIKAGNDIANCLRKNGKKVIQLSRKTFDTEYQKTRLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGERNNQILEENMDVEIWTKEGERKKLRPRWLDARTYSDPLALKEFKDFAAGRKSIALDLVTEIGRVPSHLAYRTRNALDNLVMLHTSEHGGRAYRHAVEELPETMETLLLLGLMILLTGGAMLFLISGKGIGKTSIGLICVIVSSGMLWMADVPLQWIASAIVLEFFMMVLLIPEPEKQRTPQDNQLAYVVIGILTLAAIVAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLVTHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGRRGTGSQGETLGEKWKKKLNQLSRKEFDLYKKSGITEVDRTEAKEGLKRGETTHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKYGGMLVRNPLSRNSTHEMYWISNGTGNIVSSVNMVSRLLLNRFTMTHRRPTIEKDVDLGAGTRHVNAEPETPNMDVIGERIKRIKEEHSSTWHYDDENPYKTWAYHGSYEVKATGSASSMINGVVKLLTKPWDVVPMVTQMAMTDTTPFGQQRVFKEKVDTRTPRPMPGTRKVMEITAEWLWRTLGRNKKPRLCTREEFTKKVRTNAAMGAVFTEENQWDSARAAVEDEEFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPKGTVMDIISRKDQRGSGQVGTYGLNTFTNMEAQLVRQMEGEGVLSKADLENPHLLEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLKETACLGKAYAQMWSLMYFHRRDLRLASNAICSAVPVHWIPISRTTWSIHAHHQWMTTEDMLTVWNRVWIEDNPWMEDKTPVTTWEDVPYLGKREDQWCGSLIGLTSRATWAQNILTAIQQVRSLIGDEEFLDYMPSMKRFRKEEESEGAIW

SEQ ID NO: 5036 - protein, 3290 aa, Artificial Sequence
  derived and/or modified protein sequence (wt) from DENV-3__EU660407__SS-prME
TSLCLMMMLPATLAFHLTSRDGEPRMIVGKNERGKSLLFKTASGINMCTLIAMDLGEMCDDTVTYKCPLIAEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAILPEEQDQNYVCKHTYVDRGWGNGCGLFGKGSLVTCAKFQCLEPIEGKVVQYENLKYTVIITVHTGDQHQVGNDTQGVTVEITPQASTVEAVLPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCLNTFVLKKEVSETQHGTILIKVEYKGEDAPCKIPFSTEDGQGKAHNGRLITANPVVTKKEEPVNIEAEPPFGESNIVIGIGDKALKINWYKKGSSIGKMFEATARGARRMAILGDTAWDFGSVGGVLNSLGKMVHQIFGSAYTALFSGVSWIMKIGIGVLLTWIGLNSKNTSMSFSCIVIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSASRAWNVWEVEDYGFGVFTTNIWLKLREVYTQSCDHRLMSAAIKDERAVHADMGYWIESQKNGSWKLEKASFIEVKTCTWPKSHTLWSNGVLENDMIIPKSLAGPISQHNHRPGYHTQTAGPWHLGKLELDFNYCEGTTVVITENCGTRGPSLRTTTVSGKLIHEWCCRSCTLPPLRYMGEDGCWYGMEIRPINEKEENMVKSLVSAGSGKVDNFTMGVLCLAILFEEVMRGKFGKKHMIAGVLFTFVLLLSGQITWRDMAHTLIMIGSNASDRMGMGVTYLALIATFKIQPFLALGFFLRKLTSRENLLLGVGLAMATTLQLPEDIEQMANGIALGLMTLKLITQFETYQLWTALVSLTCSNTIFTLTVAWRTATLILAGVSLLPLCQSSSMRKTDWLPMTVAAMGVPPLPLFIFSLKDTPKRRSWPLNEGVMAVGLVSILASSLLRNDVPMAGPLVAGGLLIACYVITGTSADLTVEKAADVTWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTHNGKRLEPNWASVKKDLISYGGGWRLSAQWQKGEEVQVIAVEPGKNPKNFQTMPGIFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTAEAFPQSNAPIQDEERDIPERSWNSGNEWITDFVGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGERNNQILEENMDVEIWTKEGERKKLRPRWLDARTYSDPLALKEFKDFAAGRKSIALDLVTEIGRVPSHLAYRTRNALDNLVMLHTSEHGGRAYRHAVEELPETMETLLLLGLMILLTGGAMLFLISGKGIGKTSIGLICVIVSSGMLWMADVPLQWIASAIVLEFFMMVLLIPEPEKQRTPQDNQLAYVVIGILTLAAIVAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLVTHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGRRGTGSQGETLGEKWKKKLNQLSRKEFDLYKKSGITEVDRTEAKEGLKRGETTHHAVSRGSAKLQWFVERNMVIPEGRVIDLGCGRGGWSYYCAGLKRVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKYGGMLVRNPLSRNSTHEMYWISNGTGNIVSSVNMVSRLLLNRFTMTHRRPTIEKDVDLGAGTRHVNAEPETPNMDVIGERIKRIKEEHSSTWHYDDENPYKTWAYHGSYEVKATGSASSMINGVVKLLTKPWDVVPMVTQMAMTDTTPFGQQRVFKEKVDTRTPRPMPGTRKVMEITAEWLWRTLGRNKKPRLCTREEFTKKVRTNAAMGAVFTEENQWDSARAAVEDEEFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPKGTVMDIISRKDQRGSGQVGTYGLNTFTNMEAQLVRQMEGEGVLSKADLENPHLLEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLKETACLGKAYAQMWSLMYFHRRDLRLASNAICSAVPVHWIPTSRTTWSIHAHHQWMTTEDMLTVWNRVWIEDNPWMEDKTPVTTWEDVPYLGKREDQWCGSLIGLTSRATWAQNILTAIQQVRSLIGDEEFLDYMPSMKRFRKEEESEGAIW

SEQ ID NO: 5037 - protein, 3290 aa, Artificial Sequence
  derived and/or modified protein sequence (wt) from DENV-3__EU660409__SS-prME
TSLCLMMMLPATLAFHLTSRDGEPRMIVGKNERGKSLLFKTASGINMCTLIAMDLGEMCDDTVTYKCPLIAEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATRLATLRKLCIEGKITNITTDSRCPTQGEAILPEEQDQNYVCKHTYVDRGWGNGCGLFGKGSLVTCAKFQCLELIEGKVVQYENLKYTVIITVHTGDQHQVGNDTQGATVEITPQASTVEAVLPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCLNTFVLKKEVSETQHGTILIKVEYKGEDAPCKIPFSTEDGQGKAHNGRLITANPVVTKKEEPVNIEAEPPFGESNIVIGIGDKALKINWYKKGSSIGKMFEATARGARRMAILGDTAWDFGSVGGVLNSLGKMVHQIFGSAYTALFSGVSWIMKIGIGVLLTWIGLNSKNTSMSFSCIAIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSASRAWNVWEVEDYGFGVFTTNIWLKLREVYTQSCDHRLMSAAIKDERAVHADMGYWIESQKNGSWKLEKASFIEVKTCTWPKSHTLWSNGVLESDMIIPKSLAGPISQHNHRPGYHTQTAGPWHLGKLELDFNYCEGTTVVITENCGTRGPSLRTTTVSGKLIHEWCCRSCTLPPLRYMGEDGCWYGMEIRPINEKEENMVKSLVSAGSGKVDNFTMGALCLAILFEEVMRGKFGKKHMIAGVLFTFVLLLSGQITWRDMAHTLIMIGSNASDRMGMGVTYLALIATFKIQPFLALGFFLRKLTSRENLLLGVGLAMATTLQLPEDIEQMANGIALGLMTLKLITQFETYQLWTALVSLTCSNTIFTLTVAWRTATLILAGVSLLPLCQSSSMRKTDWLPMAVAAMGVPPLPLFIFSLKDTPKRRSWPLNEGVMAVGLVSILASSLLRNDVPMAGPLVAGGLLIACYVITGTSADLTVEKVADVTWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTHNGKRLEPNWASVKKDLISYGGGWRLSAQWQKGEEVQVIAVEPGKNPKNFQTMPGIFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTAEAFPQSNAPIQDEERDIPERSWNSGNEWITDFVGKTVWFVPSIKAGNDIANCLRKNGKKVIQLSRKTFDTEYQKTRLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGERNNQILEENMDVEIWTKEGERKKLRPRWLDARTYSDPLALKEFKDFAAGRKSIALDLVTEIGRVPSHLAYRTRNALDNLVMLHTSEHGGRAYRHAVEELPETMETLLLLGLMILLTGGAMLFLISGKGIGKTSIGLICVTVSSGMLWMADVPLQWIASAIVLEFFMMVLLIPEPEKQRTPQDNQLAYVVIGILTLAAIVAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLVTHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGRRGTGSQGETLGEKWKKKLNQLSRKEFDLYKKSGITEVDRTEAKEGLKRGETTHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKYGGMLVRNPLSRNSTHEMYWISNGTGNIVSSVNMVSRLLLNRFTMTHRRPTIEKDVDLGAGTRHVNAEPETPNMDVIGERIKRIKEEHSSTWHYDDENPYKTWAYHGSYEVKATGSASSMINGVVKLLTKPWDVVPMVTQMAMTDTTPFGQQRVFKEKVDTRTPRPMPGTRKVMEITAEWLWRTLGRNKKPRLCTREEFTKKVRTNAAMGAVFTEENQWDSARAAVEDEEFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPKGTVMDIISRKDQRGSGQVGTYGLNTFTNMEAQLVRQMEGEGVLSKADLENPHLLEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLKETACLGKAYAQMWSLMYFHRRDLRLASNAICSAVPVHWIPTSRTTWSIHAHHQWMTTEDMLTVWNRVWIEDNPWMEDKTPVTTWEDVPYLGKREDQWCGSLIGLTSRATWAQNILTAIQQVRSLIGDEEFLDYMPSMKRFRKEEESEGAIW

SEQ ID NO: 5038 - protein, 3290 aa, Artificial Sequence
  derived and/or modified protein sequence (wt) from DENV-3__EU660410__SS-prME
TSLCLMMMLPATLAFHLTSRDGEPRMIVGKNERGKSLLFKTASGINMCTLIAMDLGEMCDDTVTYKCPLIAEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMARNKPTLDIELQKTEATQLATLRKLCIEGKITNITTDSRCPTQGEAILPEEQDQNYVCKHTYVDRGWGNGCGLFGKGSLVTCAKFQCLEPIEGKVVQYENLKYTVIITVHTGDQHQVGNDTQGVTVEITPQASTVEAVLPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCLNTFVLKKEVSETQHGTILIKVEYKGEDAPCKIPFSTEDGQGKAHNGRLITANPVVTKKEEPVNIEAEPPFGESNIVIGIGDKALKINWYKKGSSIGKMFEATARGARRMAILGDTAWDFGSVGGVLNSLGKMVHQIFGSAYTALFSGVSWIMKIGIGVLLTWIGLNSKNTSMSFSCIVIGIITLYLGAVVQADMGCAINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSASRAWNVWEVEDYGFGVFTTNIWLKLREVYTQSCDHRLMSAAIKDERAVHADMGYWIESQKNGSWKLEKASFIEVKTCTWPKSHTLWSNGVLESDMIIPKSLAGPISQHNHRPGYHTQTAGPWHLGKLELDFNYCEGTTVVITENCGTRGPSLRTTTVSGKLIHEWCCRSCTLPPLRYMGEDGCWYGMEIRPINEKEENMVKSLVSAGSGKVDNFTMGVLCLAILFEEVMRGKFGKKHMIAGVLFTFVLLLSGQITWRDMAHTFIMIGSNASDRMGMGVTYLALIATFKIQPFLALGFFLRKLTSRENLLLGVGLAMATTLQLPEDIEQMANGIALGLMTLKLITQFETYQLWTALVSLTCSNTIFTLTVAWRTATLVLAGVSLLPLCQSSSMRKTDWLPMTVAAMGVPPLPLFIFSLKDTPKRRSWPLNEGVMAVGLVSILASSLLRNDVPMAGPLVAGGLLIACYVITGTSADLTVEKAADVTWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTHNGKRLEPNWASVKKDLISYGGGWRLSAQWQKGEEVQVIAVEPGKNPKNFQTMPGIFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTAEAFPQSNAPIQDEERDIPERSWNSGNEWITDFVGKTVWFVPSIKAGNDIANCLRKNGKKVIQLSRKTFDTEYQKTRLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGERNNQILEENMDVEIWTKEGERKKLRPRWLDARTYSDPLALKEFKDFAAGRKSIALDLVTEIGRVPSHLAYRTRNALDNLVMLHTSEHGGRAYRHAVEELPETMETLLLLGLMILLTGGAMLFLISGKGIGKTSIGLICVIVSSGMLWMADVPLQWIASAIVLEFFMMVLLIPEPEKQRTPQDNQLAYVVIGILTLAAIVAANEMGLLETTKRDLGMSKEPGVVSPTSYLDVDLHPASAWTLYAVATTVITPMLRHTIENSTANVSLAAIANQAVVLMGLDKGWPISKMDLGAPLLALGCYSQVNPLTLTAAVLLLVTHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGRRGTGSQGETLGEKWKKKLNQLSRKEFDLYKKSGITEVDRTEAKEGLKRGETTHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKYGGMLVRNPLSRNSTHEMYWISNGTGNIVSSVNMVSRLLLNRFTMTHRRPTIEKDVDLGAGTRHVNAEPETPNMDVIGERIKRIKEEHSSTWHYDDENPYKTWAYHGSYEVKATGSASSMINGVVKLLTKPWDVVPMVTQMAMTDTTPFGQQRVFKEKVDTRTPRPMPGTRKVMEITAEWLWRTLGRNKKPRLCTREEFTKKVRTNAAMGAVFTEENQWDSARAAVEDEEFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPKGTVMDIISRKDQRGSGQVGTYGLNTFTNMEAQLVRQMEGEGVLSKADLENPHLLEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLKETACLGKAYAQMWSLMYFHRRDLRLASNAICSAVPVHWIPISRTTWSIHAHHQWMTTEDMLTVWNRVWIEDNPWMEDKTPVTTWEDVPYLGKREDQWCGSLIGLTSRATWAQNILTAIQQVRSLIGDEEFLDYMPSMKRFRKEEESEGAIW

SEQ ID NO: 5039 - protein, 3290 aa, Artificial Sequence
  derived and/or modified protein sequence (wt) from DENV-3__EU660411__SS-prME
TSLCLMMMLPATLAFHLTSRDGEPRMIVGKNERGKSLLFKTASGINMCTLIAMDLGEMCDDTVTYKCPLIAEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAILPEEQDQNYVCKHTYVDRGWGNGCGLFGKGSLVTCAKFQCLEPIEGKVVQYENLKYTVIITVHTGDQHQVGNDTQGVTVEITPQASTVEAVLPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCLNTFVLKKEVSETQHGTILIKVEYKGEDAPCKIPFSTEDGQGKAHNGRLITANPVVTKKEEPVNIEAEPPFGESNIVIGIGDKALKINWYKKGSSIGKMFEATARGARRMAILGDTAWDFGSVGGVLNSLGKMVHQIFGSAYTALFSGVSWIMKIGIGVLLTWIGLNSKNTSMSFSCIVIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSASRAWNVWEVEDYGFGVFTTNIWLKLREVYTQSCDHRLMSAAIKDERAVHADMGYWIESQKNGSWKLEKASFIEVKTCTWPKSHTLWSNGVLESDMIIPKSLAGPISQHNHRPGYHTQTAGPWHLGKLELDFNYCEGTTVVITENCGTRGPSLRTTTVSGKLIHEWCCRSCTLPPLRYMGEDGCWYGMEIRPINEKEENMVKSLVSAGSGKVDNFTMGVLCLAILFEEVMRGKFGKKHMIAGVLFTFVLLLSGQITWRDMAHTLIMIGSNASDRMGMGVTYLALIATFKIQPFLALGFFLRKLTSRENLLLGVGLAMATTLQLPEDIEQMANGIALGLMTLKLITQFETYQLWTALVSLTCSNTIFTLTVAWRTATLILAGVSLLPLCQSSSMRKTDWLPMTVAAMGVPPLPLFIFSLKDTPKRRSWPLNEGVMAVGLVSILASSLLRNDVPMAGPLVAGGLLIACYVITGTSADLTVEKAADVTWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTHNGKRLEPNWASVKKDLISYGGGWRLSAQWQKGEEVQVIAVEPGKNPKNFQTMPGIFQTTTGEIGAIALDFKPGTSGSPIINREGKIVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTAIKSEHTGREIVDLMCHATFTMRLLSPVRVPNYNLIIMDEAHFTDPASIAARGYISTRVGMGEAAAIFMTATPPGTAEAFPQSNAPIQDEERDIPERSWNSGNEWITDFVGKTVWFVPSIKAGNDIANCLRKNGKKVIQLSRKTFDTEYQKTRLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGERNNQILEENMDVEIWTKEGERKKLRPRWLDARTYSDPLALKEFKDFAAGRKSIALDLVTEIGRVPSHLAYRTRNALDNLVMLHTSEHGGRAYRHAVEELPETMETLLLLGLMILLTGGAMLFLISGKGIGKTSIGLICVIVSSGMLWMADVPLQWIASAIVLEFFMMVLLIPEPEKQRTPQDNQLAYVVIGILTLAAIVAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLVTHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGRRGTGSQGETLGEKWKKKLNQLSRKEFDLYKKSGITEVDRTEAKEGLKRGETTHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKYGGMLVRNPLSRNSTHEMYWISNGTGNIVSSVNMVSRLLLNRFTMTHRRPTIEKDVDLGAGTRHVNAEPETPNMDVIGERIKRIKEEHSSTWHYDDENPYKTWAYHGSYEVKATGSASSMINGVVKLLTKPWDVVPMVTQMAMTDTTPFGQQRVFKEKVDTRTPRPMPGTRKVMEITAEWLWRTLGRNKKPRLCTREEFTKKVRTNAAMGAVFTEENQWDSARAAVEDEEFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPKGTVMDIISRKDQRGSGQVGTYGLNTFTNMEAQLVRQMEGEGVLSKADLENPHLLEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLKETACLGKAYAQMWSLMYFHRRDLRLASNAICSAVPVHWIPTSRTTWSIHAHHQWMTTEDMLTVWNRVWIEDNPWMEDKTPVTTWEDVPYLGKREDQWCGSLIGLTSRATWAQNILTAIQQVRSLIGDEEFLDYMPSMKRFRKEEESEGAIW

SEQ ID NO: 5040 - protein, 3290 aa, Artificial Sequence
  derived and/or modified protein sequence (wt) from DENV-3__FJ432722__SS-prME
TSLCLMMMLPATLAFHLTSRDGEPRMIVGKNERGKSLLFKTASGINMCTLIAMDLGEMCDDTVTYKCPLIAEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAILPEEQDQNYVCKHTYVDRGWGNGCGLFGKGSLVTCAKFQCLEPIEGKVVQYENLKYTVIITVHTGDQHQVGNDTQGVTVEITPQASTVEAVLPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCLNTFVLKKEVSETQHGTILIKVEYKGEDAPCKIPFSTEDGQGKAHNGRLITANPVVTKKEEPVNIEAEPPFGESNIVIGIGDKALKINWYKKGSSIGKMFEATARGARRMAILGDTAWDFGSVGGVLNSLGKMVHQIFGSAYTALFSGVSWIMKIGIGVLLTWIGLNSKNTSMSFSCIVIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSASRAWNVWEVEDYGFGVFTTNIWLKLREVYTQSCDHRLMSAAIKDERAVHADMGYWIESQKNGSWKLEKASFIEVKTCTWPKSHTLWSNGVLESDMIIPKSLAGPISQHNHRPGYHTQTAGPWHLGKLELDFNYCEGTTVVITENCGTRGPSLRTTTVSGKLIHEWCCRSCTLPPLRYMGEDGCWYGMEIRPINEKEENMVKSLVSAGSGKVDNFTMGVLCLAILFEEVMRGKFGKKHMIAGVLFTFVLLLSGQITWRDMAHTLIMIGSNASDRMGMGVTYLALIATFKIQPFLALGFFLRKLTSRENLLLGVGLAMATTLQLPEDIEQMANGIALGLMTLKLITQFETYQLWTALVSLTCSNTIFTLTVAWRTATLILAGVSLLPLCQSSSMRKTDWLPMTVAAMGVPPLPLFIFSLKDTPKRRSWPLNEGVMAVGLVSILASSLLRNDVPMAGPLVAGGLLIACYVITGTSADLTVEKAADVTWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTHNGKRLEPNWASVKKDLISYGGGWRLSAQWQKGEEVQVIAVEPGKNPKNFQTMPGIFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTAEAFPQSNAPIQDEERDIPERSWNSGNEWITDFVGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGERNNQILEENMDVEIWTKEGERKKLRPRWLDARTYSDPLALKEFKDFAAGRKSIALDLVTEIGRVPSHLAYRTRNALDNLVMLHTSEHGGRAYRHAVEELPETMETLLLLGLMILLTGGAMLFLISGKGIGKTSIGLICVIVSSGMLWMADVPLQWIASAIVLEFFMMVLLIPEPEKQRTPQDNQLAYVVIGILTLAAIVAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLVTHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGRRGTGSQGETLGEKWKKKLNQLSRKEFDLYKKSGITEVDRTEAKEGLKRGETTHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKYGGMLVRNPLSRNSTHEMYWISNGTGNIVSSVNMVSRLLLNRFTMTHRRPTIEKDVDLGAGTRHVNAEPETPNMDVIGERIKRIKEEHSSTWHYDDENPYKTWAYHGSYEVKATGSASSMINGVVKLLTKPWDVVPMVTQMAMTDTTPFGQQRVFKEKVDTRTPRPMPGTRKVMEITAEWLWRTLGRNKKPRLCTREEFTKKVRTNAAMGAVFTEENQWDSARAAVEDEEFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPKGTVMDIISRKDQRGSGQVGTYGLNTFTNMEAQLVRQMEGEGVLSKADLENPHLLEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLKETACLGKAYAQMWSLMYFHRRDLRLASNAICSAVPVHWIPTSRTTWSIHAHHQWMTTEDMLTVWNRVWIEDNPWMEDKTPVTTWEDVPYLGKREDQWCGSLIGLTSRATWAQNILTAIQQVRSLIGDEEFLDYMPSMKRFRKEEESEGVIW

SEQ ID NO: 5041 - protein, 3290 aa, Artificial Sequence
  derived and/or modified protein sequence (wt) from DENV-3__FJ432728__SS-prME
TSLCLMMMLPATLAFHLTSRDGEPRMIVGKNERGKSLLFKTASGINMCTLIAMDLGEMCDDTVTYKCPLIAEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAILPEEQDQNYVCKHTYVDRGWGNGCGLFGKGSLVTCAKFQCLEPIEGKVVQYENLKYTVIITVHTGDQHQVGNDTQGVTVEITPQASTVEAVLPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCLNTFVLKKEVSETQHGTILIKVEYKGEDAPCKIPFSTEDGQGKAHNGRLITANPVVTKKEEPVNIEAEPPFGESNIVIGIGDKALKINWYKKGSSIGKMFEATARGARRMAILGDTAWDFGSVGGVLNSLGKMVHQIFGSAYTALFSGVSWIMKIGIGVLLTWIGLNSKNTSMSFSCIVIGIITLYLGAVVQADMGCAINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSASRAWNVWEVEDYGFGVFTTNIWLKLREVYTQSCDHRLMSAAIKDERAVHADMGYWIESQKNGSWKLEKASFIEVKTCTWPKSHTLWSNGVLESDMIIPKSLAGPISQHNHRPGYHTQTAGPWHLGKLELDFNYCEGTTVVITEDCGTRGPSLRTTTVSGKLIHEWCCRSCTLPPLRYMGEDGCWYGMEIRPINEKEENMVKSLVSAGSGKVDNFTMGVLCLAILFEEVMRGKFGKKHMIAGVLFTFVLLLSGQITWRDMAHTLIMIGSNASDRMGMGVTYLALIATFKIQPFLALGFFLRKLTSRENLLLGVGLAMATTLQLPEDIEQMANGIALGLMTLKLITQFETYQLWTALVSLTCSNTIFTLTVAWRTATLILAGVSLLPLCQSSSMRKTDWLPMTVAAMGVPPLPLFIFSLKDTPKRRSWPLNEGVMAVGLVSILASSLLRNDVPMAGPLVAGGLLIACYVITGTSADLTVEKAADVTWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTHNGKRLEPNWASVKKDLISYGGGWRLSAQWQKGEEVQVIAVEPGKNPKNFQTMPGIFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTAEAFPQSNAPIQDEERDIPERSWNSGNEWITDFVGKTVWFVPSIKAGNDIANCLRKNGKKVIQLSRKTFDTEYQKTRLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGERNNQILEENMDVEIWTKEGERKKLRPRWLDARTYSDPLALKEFKDFAAGRKSIALDLVTEIGRVPSHLAYRTRNALDNLVMLHTSEHGGRAYRHAVEELPETMETLLLLGLMILLTGGAMLFLISGKGIGKTSIGLICVIVSSGMLWMADVPLQWIASAIVLEFFMMVLLIPEPEKQRTPQDNQLAYVVIGILTLAAIVAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLVTHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGRRGTGSQGETLGEKWKKKLNQLSRKEFDLYKKSGITEVDRTEAKEGLKRGETTHHAVSRGSAKLQWFVERNMVIPEGRVIDLGCGRGGWSYYCAGLKKVTEVRGYTKGGPGHEEPVPMSTYGWNLVKLMSGKDVFYLPPEKCDTLLCDIGESSPSPTVEESRTIRVLKMVEPWLKNNQFCIKVLNPYMPTVIEHLERLQRKYGGMLVRNPLSRNSTHEMYWISNGTGNIVSSVNMVSRLLLNRFTMTHRRPTIEKDVDLGAGTRHVNAEPETPNMDVIGERIKRIKEEHSSTWHYDDENPYKTWAYHGSYEVKATGSASSMINGVVKLLTKPWDVVPMVTQMAMTDTTPFGQQRVFKEKVDTRTPRPMPGTRKVMEITAEWLWRTLGRNKKPRLCTREEFTKKVRTNAAMGAVFTEENQWDSARAAVEDEEFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPKGTVMDIISRKDQRGSGQVGTYGLNTFTNMEAQLVRQMEGEGVLSKADLENPHLLEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLKETACLGKAYAQMWSLMYFHRRDLRLASNAICSAVPVHWIPTSRTTWSIHAHHQWMTTEDMLTVWNRVWIEDNPWMEDKTPVTTWEDVPYLGKREDQWCGSLIGLTSRATWAQNILTAIQQVRSLIGDEEFLDYMPSMKRFRKEEESEGAIW

SEQ ID NO: 5042 - protein, 3290 aa, Artificial Sequence
  derived and/or modified protein sequence (wt) from DENV-3__FJ432731__SS-prME
TSLCLMMMLPATLAFHLTSRDGEPRMIVGKNERGKSLLFKTASGINMCTLIAMDLGEMCDDTVTYKCPLIAEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAILPEEQDQNYVCKHTYVDRGWGNGCGLFGKGSLVTCAKFQCLEPIEGKVVQYENLKYTVIITVHTGDQHQVGNDTQGVTVEITPQASTVEAVLPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCLNTFVLKKEVSETQHGTILIKVEYKGEDAPCKIPFSTEDGQGKAHNGRLITANPVVTKKEEPVNIEAEPPFGESNIVIGIGDKALKINWYKKGSSIGKMFEATARGARRMAILGDTAWDFGSVGGVLNSLGKMVHQIFGSAYTALFSGVSWIMKIGIGVLLTWIGLNSKNTSMSFSCIVIGIITLYLGAVVQADMGCAINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSASRAWNVWEVEDYGFGVFTTNIWLKLREVYTQSCDHRLMSAAIKDERAVHADMGYWIESQKNGSWKLEKASFIEVKTCTWPKSHTLWSNGVLESDMIIPKSLAGPISQHNHRPGYHTQTAGPWHLGKLELDFNYCEGTTVVITENCGTRGPSLRTTTVSGKLIHEWCCRSCTLPPLRYMGEDGCWYGMEIRPINEKEENMVKSLVSAGSGKVDNFTMGVLCLAILFEEVMRGKFGKKHMIAGVLFMFVLLLSGQITWRDMAQTLIMIGSNASDRMGMGVTYLALIATFKIQPFLALGFFLRKLTSRENLLLGVGLAMTTTLQLPEDIEQMANGIALGLMTLKLITQFETYQLWTALVSLTCSNTIFTLTVAWRTATLILAGVSLLPLCQSSSMRKTDWLPMTVAAMGVPPLPLFIFSLKDTPKRRSWPLNEGVMAVGLVSILASSLLRNDVPMAGPLVAGGLLIACYVITGTSADLTVEKAADVTWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTHNGKRLEPNWASVKKDLISYGGGWRLSAQWQKGEEVQVIAVEPGKNPKNFQTMPGIFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTAEAFPQSNAPIQDEERDIPERSWNSGNEWITDFVGKTVWFVPSIKAGNDIANCLRKNGKKVIQLSRKTFDTEYQKTRLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGERNNQILEENMDVEIWTKEGERKKLRPRWLDARTYSDPLALKEFKDFAAGRKSIALDLVTEIGRVPSHLAYRTRNALDNLVMLHTSEHGGRAYRHAVEELPETMETLLLLGLMILLTGGAMLFLISGKGIGKTSIGLICVIVSSGMLWMADVPLQWIASAIILEFFMMVLLIPEPEKQRTPQDNQLAYVVIGILTLAAIVAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLVTHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGRRGTGSQGETLGEKWKKKLNQLSRKEFDLYKKSGITEVDRTEAKEGLKRGETTHHAVSRGSAKLQWFVERNMVIPEGRVIDLGCGRGGWSYYCAGLKKVTEVRGYTKGGPGHEEPVPMSTYGWNLVKLMSGKDVFYLPPEKCDTLLCDIGESSPSPTVEESRTIRVLKMVEPWLKNNQFCIKVLNPYMPTVIEHLERLQRKYGGMLVRNPLSRNSTHEMYWISNGTGNIVSSVNMVSRLLLNRFTMTHRRPTIEKDVDLGAGTRHVNAEPETPNMDVIGERIKRIKEEHSSTWHYDDENPYKTWAYHGSYEVKATGSASSMINGVVKLLTKPWDVVPMVTQMAMTDTTPFGQQRVFKEKVDTRTPRPMPGTRKVMEITAEWLWRTLGRNKKPRLCTREEFTKKVRTNAAMGAVFTEENQWDSARAAVEDEEFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPKGTVMDIISRKDQRGSGQVGTYGLNTFTNMEAQLVRQMEGEGVLSKADLENPHLLEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLKETACLGKAYAQMWSLMYFHRRDLRLASNAICSAVPVHWIPTSRTTWSIHAHHQWMTTEDMLTVWNRVWIEDNPWMEDKTPVTTWEDVPYLGKREDQWCGSLIGLTSRATWAQNILTAIQQVRSLIGDEEFLDYMPSMKRFRKEEESEGAIW

SEQ ID NO: 5043 - protein, 3290 aa, Artificial Sequence
  derived and/or modified protein sequence (wt) from DENV-3__FJ562097__SS-prME
TSLCLMMMLPATLAFHLTSRDGEPRMIVGKNERGKSLLFKTASGINMCTLIAMDLGEMCDDTVTYKCPLIAEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAILPEEQDQNYVCKHTYVDRGWGNGCGLFGKGSLVTCAKFQCLEPIEGKVVQYENLKYTVIITVHTGDQHQVGNDTQGVTVEITPQASTVEAVLPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCLNTFVLKKEVSETQHGTILIKVEYKGEDAPCKIPFSTEDGQGKAHNGRLITANPVVTKKEEPVNIEAEPPFGESNIVIGIGDKALKINWYKKGSSIGKMFEATARGARRMAILGDTAWDFGSVGGVLNSLGKMVHQIFGSAYTALFSGVSWIMKIGIGVLLTWIGLNSKNTSMSFSCIVIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSASRAWNVWEVEDYGFGVFTTNIWLKLREVYTQSCDHRLMSAAIKDERAVHADMGYWIESQKNGSWKLEKASFIEVKTCTWPKSHTLWSNGVLESDMIIPKSLAGPISQHNHRPGYHTQTAGPWHLGKLELDFNYCEGTTVVITENCGTRGPSLRTTTVSGKLIHEWCCRSCTLPPLRYMGEDGCWYGMEIRPINEKEENMVKSLVSAGSGKVDNFTMGVLCLAILFEEVMRGKFGKKHMIAGVLFTFVLLLSGQITWRDMAHTLIMIGSNASDRMGMGVTYLALIATFKIQPFLALGFFLRKLTSRENLLLGVGLAMAATLQLPEDIEQMANGIALGLMTLKLITQFETYQLWTALVSLTCSNTIFTLTVAWRTATLILAGVSLLPLCQSSSMRKTDWLPMTVAAMGVPPLPLFIFSLKDTPKRRSWPLNEGVMAVGLVSILASSLLRNDVPMAGPLVAGGLLIACYVITGTSADLTVEKAADVTWEEEAEQTGVSHNLMITVDDDGTMRIKDDETENILTVLLKTALLIVSGVFPYSIPATLLVWHTWQKQTQRSGVLWDVPSPPETQKAELEEGVYRIKQQGIFGKTQVGVGVQKEGVFHTMWHVTRGAVLTHNGKRLEPNWASVKKDLISYGGGWRLSAQWQKGEEVQVIAVEPGKNPKNFQTMPGIFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTAEAFPQSNAPIQDEERDIPERSWNSGNEWITDFVGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGERNNQILEENMDVEIWTKEGERKKLRPRWLDARTYSDPLALKEFKDFAAGRKSIALDLVTEIGRVPSHLAYRTRNALDNLVMLHTSEHGGRAYRHAVEELPETMETLLLLGLMILLTGGAMLFLISGKGIGKTSIGLICVIVSSGMLWMADVPLQWIASAIVLEFFMMVLLIPEPEKQRTPQDNQLAYVVIGILTLAAIVAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLVTHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGRRGTGSQGETLGEKWKKKLNQLSRKEFDLYKKSGITEVDRTEAKEGLKRGETTHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKYGGMLVRNPLSRNSTHEMYWISNGTGNIVSSVNMVSRLLLNRFTMTHRRPTIEKDVDLGAGTRHVNAEPETPNMDVIGERIKRIKEEHSSTWHYDDENPYKTWAYHGSYEVKATGSASSMINGVVKLLTKPWDVVPMVTQMAMTDTTPFGQQRVFKEKVDTRTPRPMPGTRKVMEITAEWLWRTLGRNKKPRLCTREEFTKKVRTNAAMGAVFTEENQWDSARAAVEDEEFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPKGTVMDIISRKDQRGSGQVGTYGLNTFTNMEAQLVRQMEGEGVLSKADLENPHLLEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLKETACLGKAYAQMWSLMYFHRRDLRLASNAICSAVPVHWIPTSRTTWSIHAHHQWMTTEDMLTVWNRVWIEDNPWMEDKTPVTTWEDVPYLGKREDQWCGSLIGLTSRATWAQNILTAIQQVRSLIGDEEFLDYMPSMKRFRKEEESEGAIW

SEQ ID NO: 5044 - protein, 3290 aa, Artificial Sequence
  derived and/or modified protein sequence (wt) from DENV-3__FJ432741__SS-prME
TSLCLMMMLPATLAFHLTSRDGEPRMIVGKNERGKSLLFKTASGINMCTLIAMDLGEMCDDTVTYKCPLIAEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAILPEEQDQNYVCKHTYVDRGWGNGCGLFGKGSLVTCAKFQCLEPIEGKVVQYENLKYTVIITVHTGDQHQVGNDTQGVTVEITPQASTVEAVLPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCLNTFVLKKEVSETQHGTILIKVEYKGEDAPCKIPFSTEDGQGKAHNGRLITANPVVAKKEEPVNIEAEPPFGESNIVIGIGDKALKINWYKKGSSIGKMFEATARGARRMAILGDTAWDFGSVGGVLNSLGKMVHQIFGSAYTALFSGVSWIMKIGIGVLLTWIGLNSKNTSMSFSCIVIGIITLYLGAVVQADMGCAINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSASRAWNVWEVEDYGFGVFTTNIWLKLREVHTQSCDHRLMSAAIKDERAVHADMGYWIESQKNGSWKLEKASFIEVKTCTWPKSHTLWSNGVLESDMVIPKSLAGPISQHNHRPGYHTQTAGPWHLGKLELDFNYCEGTTVVITENCGTRGPSLRTTTVSGKLIHEWCCRSCTLPPLRYMGEDGCWYGMEIRPINEKEENMVKSLVSAGSGKVDNFTMGVLCLAILFEEVMRGKFGKKHMIAGVLFTFVLLLSGQITWRDMAHTLIMIGSNASDRMGMGVTYLALIATFKIQPFLALGFFLRKLTSRENLLLGVGLAMATTLQLPEDIEQMANGIALGLMTLKLITQFETYQLWTALVSLTCSNTIFTLTVAWRTATLILAGVSLLPLCQSSSMRKTDWLPMTVAAMGVPPLPLFIFSLKDTPKRRSWPLNEGVMAVGLVSILASSLLRNDVPMAGPLVAGGLLIACYVITGTSADLTVEKAADVTWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTHNGKRLEPNWASVKKDLISYGGGWRLSAQWQKGEEVQVIAVEPGKNPKNFQTMPGIFQTTTGEIGAIALDFKPGTSGSPIINREGKVVGLYGNGVVTKNGGYVSGIAQTNAEPDGPTPELEEEVFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTAEAFPQSNAPIQDEERDIPERSWNSGNEWITDFVGKTVWFVPSIKAGNDIANCLRKNGKKVIQLSRKTFDTEYQKTRLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGERNNQILEENMDVEIWTKEGERKKLRPRWLDARTYSDPLALKEFKDFAAGRKSIALDLVTEIGRVPSHLAYRTRNALDNLVMLHTSEHGGRAYRHAVEELPETMETLLLLGLMILLTGGAMLFLISGKGIGKTSIGLICVIVSSGMLWMADVPLQWIASAIILEFFMMVLLIPEPEKQRTPQDNQLAYVVIGILTLAAIVAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLVTHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGRRGTGSQGETLGEKWKKKLNQLSRKEFDLYKKSGITEVDRTEAKEGLKRGETTHHAVSRGSAKLQWFVERNMVIPEGRVIDLGCGRGGWSYYCAGLKKVTEVRGYTKGGPGHEEPVPMSTYGWNLVKLMSGKDVFYLPPEKCDTLLCDIGESSPSPTVEESRTIRVLKMVEPWLKNNQFCIKVLNPYMPTVIEHLERLQRKYGGMLVRNPLSRNSTHEMYWISNGTGNIVSSVNMVSRLLLNRFTMTHRRPTIEKDVDLGAGTRHVNAEPETPNMDVIGERIKRIKEEHSSTWHYDDENPYKTWAYHGSYEVKATGSASSMINGVVKLLTKPWDVVPMVTQMAMTDTTPFGQQRVFKEKVDTRTPRPMPGTRKVMEITAEWLWRTLGRNKKPRLCTREEFTKKVRTNAAMGAVFTEENQWDSARAAVEDEEFWKLVDRERKLHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPKGTVMDIISRKDQRGSGQVGTYGLNTFTNMEAQLVRQMEGEGVLSKADLENPHLLEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLKETACLGKAYAQMWSLMYFHRRDLRLASNAICSAVPVHWIPTSRTTWSIHAHHQWMTTEDMLTVWNRVWIEDNPWMEDKTPVTTWEDVPYLGKREDQWCGSLIGLTSRATWAQNILTAIQQVRSLIGDEEFLDYMPSMKRFRKEEESEGAIW

SEQ ID NO: 5045 - protein, 3290 aa, Artificial Sequence
  derived and/or modified protein sequence (wt) from DENV-3__FJ562099__SS-prME
TSLCLMMMLPATLAFHLTSRDGEPRMIVGKNERGKSLLFKTASGINMCTLIAMDLGEMCDDTVTYKCPLIAEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAILPEEQDQNYVCKHTYVDRGWGNGCGLFGKGSLVTCAKFQCLEPIEGKVVQYENLKYTVIITVHTGDQHQVGNDTQGVTVEITPQASTVEAVLPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCLNTFVLKKEVSETQHGTILIKVEYKGEDAPCKIPFSTEDGQGKAHNGRLITANPVVTKKEEPVNIEAEPPFGESNIVIGIGDKALKINWYKKGSSIGKMFEATARGARRMAILGDTAWDFGSVGGVLNSLGKMVHQIFGSAYTALFSGVSWIMKIGIGVLLTWIGLNSKNTSMSFSCIVIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSASRAWNVWEVEDYGFGVFTTNIWLKLREVYTQSCDHRLMSAAIKDERAVHADMGYWIESQKNGSWKLEKASFIEVKTCTWPKSHTLWSNGVLESDMIIPKSLAGPISQHNHRPGYHTQTAGPWHLGKLELDFNYCEGTTVVITENCGTRGPSLRTTTVSGKLIHEWCCRSCTLPPLRYMGEDGCWYGMEIRPINEKEENMVKSLVSAGSGKVDNFTMGVLCLAILFEEVMRGKFGKKHMIAGVLFTFVLLLSGQITWRDMAHTLIMIGSNASDRMGMGVTYLALIATFKIQPFLALGFFLRKLTSRENLLLGVGLAMATTLQLPEDIEQMANGIALGLMTLKLITQFETYQLWTALVSLTCSNTIFTLTVAWRTATLILAGVSLLPLCQSSSMRKTDWLPMTVAAMGVPPLPLFIFSLKDTPKRRSWPLNEGVMAVGLVSILASSLLRNDVPMAGPLVAGGLLIACYVITGTSADLTVEKAADVTWEEEAEQTGVSHNLMITVDDDGTMRIKDDETENILTVLLKTALLIVSGVFPYSIPATLLVWHTWQKQTQRSGVLWDVPSPPETQKAELEEGVYRIKQQGIFGKTQVGVGVQKEGVFHTMWHVTRGAVLTHNGKRLEPNWASVKKDLISYGGGWRLSAQWQKGEEVQVIAVEPGKNPKNFQTMPGIFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTAEAFPQSNAPIQDEERDIPERSWNSGNEWITDFVGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGERNNQILEENMDVEIWTKEGERKKLRPRWLDARTYSDPLALKEFKDFAAGRKSIALDLVTEIGRVPSHLAYRTRNALDNLVMLHTSEHGGRAYRHAVEELPETMETLLLLGLMILLTGGAMLFLISGKGIGKTSIGLICVIVSSGMLWMADVPLQWIASAIVLEFFMMVLLIPEPEKQRTPQDNQLAYVVIGILTLAAIVAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLVTHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGRRGTGSQGETLGEKWKKKLNQLSRKEFDLYKKSGITEVDRTEAKEGLKRGETTHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKYGGMLVRNPLSRNSTHEMYWISNGTGNIVSSVNMVSRLLLNRFTMTHRRPTIEKDVDLGAGTRHVNAEPETPNMDVIGERIKRIKEEHSSTWHYDDENPYKTWAYHGSYEVKATGSASSMINGVVKLLTKPWDVVPMVTQMAMTDTTPFGQQRVFKEKVDTRTPRPMPGTRKVMEITAEWLWRTLGRNKKPRLCTREEFTKKVRTNAAMGAVFTEENQWDSARAAVEDEEFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPKGTVMDIISRKDQRGSGQVGTYGLNTFTNMEAQLVRQMEGEGVLSKADLENPHLLEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLKETACLGKAYAQMWSLMYFHRRDLRLASNAICSAVPVHWIPTSRTTWSIHAHHQWMTTEDMLTVWNRVWIEDNPWMEDKTPVTTWEDVPYLGKREDQWCGSLIGLTSRATWAQNILTAIQQVRSLIGDEEFLDYMPSMKRFRKEEESEGAIW

SEQ ID NO: 5046 - protein, 3290 aa, Artificial Sequence
  derived and/or modified protein sequence (wt) from DENV-3__KF955457__SS-prME
TSLCLMMMLPATLAFHLTSRDGEPRMIVGKNERGKSLLFKTASGINMCTLIAMDLGEMCDDTVTYKCPLIAEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAILPEEQDQNYVCKHTYVDRGWGNGCGLFGKGSLVTCAKFQCLEPIEGKVVQYENLKYTVIITVHTGDQHQVGNDTQGATVEITPQASTVEAVLPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCLNTFVLKKEVSETQHGTILIKVEYKGEDAPCKIPFSTEDGQGKAHNGRLITANPVVTKKEEPVNIEAEPPFGESNIVIGIGDKALKINWYKKGSSIGKMFEATARGARRMAILGDTAWDFGSVGGVLNSLGKMVHQIFGSAYTALFSGVSWIMKIGIGVLLTWIGLNSKNTSMSFSCIVIGIITLYLGAVVQADMGCAINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNFSFIIDGPNTPECPSASRAWNVWEVEDYGFGVFTTNIWLKLREVYTQSCDHRLMSAAIKDERAVHADMGYWIESQKNGSWKLEKASFIEVKTCTWPKSHTLWSNGVLESDMIIPKSLAGPISQHNHRPGYHTQTAGPWHLGKLELDFNYCEGTTVVITEDCGTRGPSLRTTTVSGKLIHEWCCRSCTLPPLRYMGEDGCWYGMEIRPINEKEENMVKSLVSAGSGKVDNFTMGVLCLAILFEEVMRGKFGKKHMIAGVLFTFVLLLSGQITWRDMAHTLIMIGSNASDRMGMGVTYLALIATFKIQPFLALGFFLRKLTSRENLLLGVGLAMATTLQLPEDIEQMANGIALGLMTLKLITQFETYQLWTALVSLTCSNTIFTLTVAWRTATLILAGVSLLPLCQSSSMRKTDWLPMTVAAMGVPPLPLFIFSLKDTPKRRSWPLNEGVMAVGLVSILASSLLRNDVPMAGPLVAGGLLIACYVITGTSADLTVEKAADVTWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTHNGKRLEPNWASVKKDLISYGGGWRLSAQWQKGEEVQVIAVEPGKNPKNFQTMPGIFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTAEAFPQSNAPIQDEERDIPERSWNSGNEWITDFVGKTVWFVPSIKAGNDIANCLRKNGKKVIQLSRKTFDTEYQKTRLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGERNNQILEENMDVEIWTKEGERKKLRPRWLDARTYSDPLALKEFKDFAAGRKSIALDLVTEIGRVPSHLAYRTRNALDNLVMLHTSEHGGRAYRHAVEELPETMETLLLLGLMILLTGGAMLFLISGKGIGKTSIGLICVIVSSGMLWMADVPLQWIASAIVLEFFMMVLLIPEPEKQRTPQDNQLAYVVIGILTLAAIVAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLVTHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGRRGTGSQGETLGEKWKKKLNQLSRKEFDLYKKSGITEVDRTEAKEGLKRGETTHHAVSRGSAKLQWFVDRNMVIPEGRVIDLGCGRGGWSYYCAGLKKVTEVRGYTKGGPGHEEPVPMSTYGWNLVKLMSGKDVFYLPPEKCDTLLCDIGESSPSPTVEESRTIRVLKMVEPWLKNNQFCIKVLNPYMPTVIEHLERLQRKYGGMLVRNPLSRNSTHEMYWISNGTGNIVSSVNMVSRLLLNRFTMTHRRPTIEKDVDLGAGTRHVNAEPETPNMDVIGERIKRIKEEHSSTWHYDDENPYKTWAYHGSYEVKATGSASSMINGVVKLLTKPWDVVPMVTQMAMTDTTPFGQQRVFKEKVDTRTPRPMPGTRKVMEITAEWLWRTLGRNKKPRLCTREEFTKKVRTNAAMGAVFTEENQWDSARAAVEDEEFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPKGTVMDIISRKDQRGSGQVGTYGLNTFTNMEAQLVRQMEGEGVLSKADLENPHLLEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLKETACLGKAYAQMWSLMYFHRRDLRLASNAICSAVPVHWIPTSRTTWSIHAHHQWMTTEDMLTVWNRVWIEDNPWMEDKTPVTTWEDVPYLGKREDQWCGSLIGLTSRATWAQNILTAIQQVRSLIGDEEFLDYMPSMKRFRKEEESEGAIW

SEQ ID NO: 5047 - protein, 3290 aa, Artificial Sequence
  derived and/or modified protein sequence (wt) from DENV-3__FJ562100__SS-prME
TSLCLMMMLPATLAFHLTSRDGEPRMIVGKNERGKSLLFKTASGINMCTLIAMDLGEMCDDTVTYKCPLIAEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAILPEEQDQNYVCKHTYVDRGWGNGCGLFGKGSLVTCAKFQCLEPIEGKVVQYENLKYTVIITVHTGDQHQVGNDTQGVTVEITPQASTVEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCLNTFVLKKEVSETQHGTILIKVEYKGEDAPCKIPFSTEDGQGKAHNGRLITANPVVTKKEEPVNIEAEPPFGESNIVIGIGDKALKINWYKKGSSIGKMFEATARGARRMAILGDTAWDFGSVGGVLNSLGKMVHQIFGSAYTALFSGVSWIMKIGIGVLLTWIGLNSKNTSMSFSCIVIGIITLYLGAVVQADMGCAINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSASRAWNVWEVEDYGFGVFTTNIWLKLREVYTQSCDHRLMSAAIKDERAVHADMGYWIESQKNGSWKLEKASFIEVKTCTWPKSHTLWSNGVLESDMIIPKSLAGPISQHNHRPGYHTQTAGPWHLGKLELDFNYCEGTTVVITENCGTRGPSLRTTTVSGKLIHEWCCRSCTLPPLRYMGEDGCWYGMEIRPINEKEENMVKSLVSAGSGKVDNFTMGVLCLAILFEEVMRGKFGKKHMIAGVLFTFVLLLSGQITWRDMAHTLIMIGSNASDRMGMGVTYLALIATFKIQPFLALGFFLRKLTSRENLLLGVGLAMATTLQLPEDIEQMANGIALGLMTLKLITQFETYQLWTALVSLTCSNTIFTLTVAWRTATLILAGVSLLPLCQSSSMRKTDWLPMTVAAMGVPPLPLFIFSLKDTPKRRSWPLNEGVMAVGLVSILASSLLRNDVPMAGPLVAGGLLIACYVITGTSADLTVEKAADVTWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTHNGKRLEPNWASVKKDLISYGGGWRLSAQWQKGEEVQVIAVEPGKNPKNFQTMPGIFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTAEAFPQSNAPIQDEERDIPERSWNSGNEWITDFVGKTVWFVPSIKAGNDIANCLRKNGKKVIQLSRKTFDTEYQKTRLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGERNNQILEENMDVEIWTKEGERKKLRPRWLDARTYSDPLALKEFKDFAAGRKSIALDLVTEIGRVPSHLAYRTRNALDNLVMLHTSEHGGRAYRHAVEELPETMETLLLLGLMILLTGGAMLFLISGKGIGKTSIGLICVTVSSGMLWMADVPLQWIASAIVLEFFMMVLLIPEPEKQRTPQDNQLAYVVIGILTLAAIVAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLVTHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGRRGTGSQGETLGEKWKKKLNQLSRKEFDLYKKSGITEVDRTEAKEGLKRGETTHHAVSRGSAKLQWFVERNMVIPEGRVIDLGCGRGGWSYYCAGLKKVTEVRGYTKGGPGHEEPVPMSTYGWNLVKLMSGKDVFYLPPEKCDTLLCDIGESSPSPTVEESRTIRVLKMVEPWLKNNQFCIKVLNPYMPTVIEHLERLQRKYGGMLVRNPLSRNSTHEMYWISNGTGNIVSSVNMVSRLLLNRFTMTHRRPTIEKDVDLGAGTRHVNAEPETPNMDVIGERIKRIKEEHSSTWHYDDENPYKTWAYHGSYEVKATGSASSMINGVVKLLTKPWDVVPMVTQMAMTDTTPFGQQRVFKEKVDTRTPRPMPGTRKVMEITAEWLWRTLGRNKKPRLCTREEFTKKVRTNAAMGAVFTEENQWDSARAAVEDEEFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPKGTVMDIISRKDQRGSGQVGTYGLNTFTNMEAQLVRQMEGEGVLSKADLENPHLLEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLKETACLGKAYAQMWSLMYFHRRDLRLASNAICSAVPVHWIPTSRTTWSIHAHHQWMTTEDMLTVWNRVWIEDNPWMEDKTPVTTWEDVPYLGKREDQWCGSLIGLTSRATWAQNILTAIQQVRSLIGDEEFLDYMPSMKRFRKEEESEGAIW

SEQ ID NO: 5048 - protein, 3290 aa, Artificial Sequence
  derived and/or modified protein sequence (wt) from DENV-3__FJ547062__SS-prME
TSLCLMMMLPATLAFHLTSRDGEPRMIVGKNERGKSLLFKTASGINMCTLIAMDLGEMCDDTVTYKCPLIAEVEPEDIDCWCNLTSTWVTYGTCNQAGEHRRDKRSVALAPHVGMGLDTRTQTWMSAEGAWRQVEKVETWALRHPGFTILALFLAHYISTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAILPEEQDQNYVCKHTYVDRGWGNGCGLFGKGSLVTCAKFQCLEPIEGKVVQYENLKYTVIITVHTGDQHQVGNDTQGVTVEITPQASTVEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCLNTFVLKKEVSETQHGTILIKVEYKGEDAPCKIPFSTEDGQGKAHNGRLITANPVVTKKEEPVNIEAEPPFGESNIVIGIGDKALKINWYKKGSSIGKMFEATARGARRMAILGDTAWDFGSVGGVLNSLGKMVHQIFGSAYTALFSGVSWIMKIGIGVLLTWIGLNSKNTSMSFSCIVIGIITLYLGAVVQADMGCAINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSASRAWNVWEVEDYGFGVFTTNIWLKLREVYTQSCDHRLMSAAIKDERAVHADMGYWIESQKNGSWKLEKASFIEVKTCTWPKSHTLWSNGVLESDMIIPKSLAGPISQHNHRPGYHTQTAGPWHLGKLELDFNYCEGTTVVITENCGTRGPSLRTTTVSGKLIHEWCCRSCTLPPLRYMGEDGCWYGMEIRPINEKEENMVKSLVSAGSGKVDNFTMGVLCLAILFEEVMRGKFGKKHMIAGVLFTFVLLLSGQITWRDMAHTLIMIGSNASDRMGMGVTYLALIATFKIQPFLALGFFLRKLTSRENLLLGVGLAMATTLQLPEDIEQMANGIALGLMTLKLITQFETYQLWTALVSLTCSNTIFTLTVAWRTATLILAGVSLLPLCQSSSMRKTDWLPMTVAAMGVPPLPLFIFSLKDTPKRRSWPLNEGVMAVGLVSILASSLLRNDVPMAGPLVAGGLLIACYVITGTSADLTVEKAADVTWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTHNGKRLEPNWASVKKDLISYGGGWRLSAQWQKGEEVQVIAVEPGKNPKNFQTMPGIFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTAEAFPQSNAPIQDEERDIPERSWNSGNEWITDFVGKTVWFVPSIKAGNDIANCLRKNGKKVIQLSRKTFDTEYQKTRLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGERNNQILEENMDVEIWTKEGERKKLRPRWLDARTYSDPLALKEFKDFAAGRKSIALDLVTEIGRVPSHLAYRTRNALDNLVMLHTSEHGGRAYRHAVEELPETMETLLLLGLMILLTGGAMLFLISGKGIGKTSIGLICVIVSSGMLWMADVPLQWIASAIVLEFFMMVLLIPEPEKQRTPQDNQLAYVVIGILTLAAIVAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLVTHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGRRGTGSQGETLGEKWKKKLNQLSRKEFDLYKKSGITEVDRTEAKEGLKRGETTHHAVSRGSAKLQWFVERNMVIPEGRVIDLGCGRGGWSYYCAGLKKVTEVRGYTKGGPGHEEPVPMSTYGWNLVKLMSGKDVFYLPPEKCDTLLCDIGESSPSPTVEESRTIRVLKMVEPWLKNNQFCIKVLNPYMPTVIEHLERLQRKYGGMLVRNPLSRNSTHEMYWISNGTGNIVSSVNMVSRLLLNRFTMTHRRPTIEKDVDLGAGTRHVNAEPETPNMDVIGERIKRIKEEHSSTWHYDDENPYKTWAYHGSYEVKATGSASSMINGVVKLLTKPWDVVPMVTQMAMTDTTPFGQQRVFKEKVDTRTPRPMPGTRKVMEITAEWLWRTLGRNKKPRLCTREEFTKKVRTNAAMGAVFTEENQWDSARAAVEDEEFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPKGTVMDIISRKDQRGSGQVGTYGLNTFTNMEAQLVRQMEGEGVLSKADLENPHLLEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLKETACLGKAYAQMWSLMYFHRRDLRLASNAICSAVPVHWIPTSRTTWSIHAHHQWMTTEDMLTVWNRVWIEDNPWMEDKTPVTTWEDVPYLGKREDQWCGSLIGLTSRATWAQNILTAIQQVRSLIGDEEFLDYMPSMKRFRKEEESEGAIW

SEQ ID NO: 5049 - protein, 3290 aa, Artificial Sequence
  derived and/or modified protein sequence (wt) from DENV-3__FJ461322__SS-prME
TSLCLMMMLPATLAFHLTSRDGEPRMIVGKNERGKSLLFKTASGINMCTLIAMDLGEMCDDTVTYKCPLIAEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAILPEEQDQNYVCKHTYVDRGWGNGCGLFGKGSLVTCAKFQCLEPIEGKVVQYENLKYTVIITVHTGDQHQVGNDTQGVTVEITPQASTVEAVLPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCLNTFVLKKEVSETQHGTILIKVEYKGEDAPCKIPFSTEDGQGKAHNGRLITANPVVTKKEEPVNIEAEPPFGESNIVIGIGDKALKINWYKKGSSIGKMFEATARGARRMAILGDTAWDFGSVGGVLNSLGKMVHQIFGSAYTALFSGVSWIMKIGIGVLLTWIGLNSKNTSMSFSCIVIGIITLYLGAVVQADMGCAINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSASRAWNVWEVEDYGFGVFTTNIWLKLREVYTQSCDHRLMSAAIKDERAVHADMGYWIESQKNGSWKLEKASFIEVKTCTWPKSHTLWSNGVLESDMIIPKSLAGPISQHNHRPGYHTQTAGPWHLGKLELDFNYCEGTTVVITENCGTRGPSLRTTTVSGKLIHEWCCRSCTLPPLRYMGEDGCWYGMEIRPINEKEENMVKSLVSAGSGKVDNFTMGVLCLAILFEEVMRGKFGKKHMIAGVLFTFVLLLSGQITWRDMAHTLIMIGSNASDRMGMGVTYLALIATFKIQPFLALGFFLRKLTSRENLLLGVGLAMATTLQLPEDIEQMANGIALGLMTLKLITQFETYQLWTALVSLTCSNTIFTLTVAWRTATLILAGVSLLPLCQSSSMRKTDWLPMTVAAMGVPPLPLFIFSLKDTPKRRSWPLNEGVMAVGLVSILASSLLRNDVPMAGPLVAGGLLIACYVITGTSADLTVEKAADVTWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTHNGKRLEPNWASVKKDLISYGGGWRLSAQWQKGEEVQVIAVEPGKNPKNFQTMPGIFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTAEAFPQSNAPIQDEERDIPERSWNSGNEWITDFVGKTVWFVPSIKAGNDIANCLRKNGKKVIQLSRKTFDTEYQKTRLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGERNNQILEENMDVEIWTKEGERKKLRPRWLDARTYSDPLALKEFKDFAAGRKSIALDLVTEIGRVPSHLAYRTRNALDNLVMLHTSEHGGRAYRHAVEELPETMETLLLLGLMILLTGGAMLFLISGKGIGKTSIGLICVIVSSGMLWMAEVPLQWIASAIVLEFFMMVLLIPEPEKQRTPQDNQLAYVVIGILTLAAIVAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLVTHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGRRGTGSQGETLGEKWKKKLNQLSRKEFDLYKKSGITEVDRTEAKEGLKRGETTHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKYGGMLVRNPLSRNSTHEMYWISNGTGNIVSSVNMVSRLLLNRFTMTHRRPTIEKDVDLGAGTRHVNAEPETPNMDVIGERIKRIKEEHSSTWHYDDENPYKTWAYHGSYEVKATGSASSMINGVVKLLTKPWDVVPMVTQMAMTDTTPFGQQRVFKEKVDTRTPRPMPGTRKVMEITAEWLWRTLGRNKKPRLCTREEFTKKVRTNAAMGAVFTEENQWDSARAAVEDEEFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPKGTVMDIISRKDQRGSGQVGTYGLNTFTNMEAQLVRQMEGEGVLSKADLENPHLLEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLKETACLGKAYAQMWSLMYFHRRDLRLASNAICSAVPVHWIPTSRTTWSIHAHHQWMTTEDMLTVWNRVWIEDNPWMEDKTPVTTWEDIPYLGKREDQWCGSLIGLTSRATWAQNILTAIQQVRSLIGDEEFLDYMPSMKRFRKEEESEGAIW

SEQ ID NO: 5050 - protein, 3290 aa, Artificial Sequence
  derived and/or modified protein sequence (wt) from DENV-3__KF955458__SS-prME
TSLCLMMMLPATLAFHLTSRDGEPRMIVGKNERGKSLLFKTASGINMCTLIAMDLGEMCDDTVTYKCPLIAEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAILPEEQDQNYVCKHTYVDRGWGNGCGLFGKGSLVTCAKFQCLEPIEGKVVQYENLKYTVIITVHTGDQHQVGNDTQGVTVEITPQASTVEAVLPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCLNTFVLKKEVSETQHGTILIKVEYKGEDAPCKIPFSTEDGQGKAHNGRLITANPVVTKKEEPVNIEAEPPFGESNIVIGIGDKALKINWYKKGSSIGKMFEATARGARRMAILGDTAWDFGSVGGVLNSLGKMVHQIFGSAYTALFSGVSWIMKIGIGVLLTWIGLNSKNTSMSFSCIVIGIITLYLGAVVQADMGCAINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSASRAWNVWEVEDYGFGVFTTNIWLKLREVNTQSCDHRLMSAAIKDERAVHADMGYWIESQKNGSWKLEKASFIEVKTCTWPKSHTLWSNGVLESDMIIPKSLAGPISQHNHRPGYHTQTAGPWHLGKLELDFNYCEGTTVVITENCGTRGPSLRTTTVSGKLIHEWCCRSCTLPPLRYMGEDGCWYGMEIRPINEKEENMVKSLVSAGSGKVDNFTMGVLCLAILFEEVMRGKFGKKHMIAGVLFTFVLLLSGQITWRDMAHTLIMIGSNASDRMGMGVTYLALIATFKIQPFLALGFFLRKLTSRENLLLGVGLAMATTLQLPEDIEQMANGIALGLMTLKLITQFETYQLWTALVSLTCSNTIFTLTVAWRTATLILAGVSLLPLCQSSSMRKTDWLPMTVAAMGVPPLPLFIFSLKDTPKRRSWPLNEGVMAVGLVSILASSLLRNDVPMAGPLVAGGLLIACYVITGTSADLTVEKAADVTWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTHNGKRLEPNWASVKKDLISYGGGWRLSAQWQKGEEVQVIAVEPGKNPKNFQTMPGIFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTAEAFPQSNAPIQDEERDIPERSWNSGNEWITDFVGKTVWFVPSIKAGNDIANCLRKNGKKVIQLSRKTFDTEYQKTRLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGERNNQILEENMDVEIWTKEGERKKLRPRWLDARTYSDPLALKEFKDFAAGRKSIALDLVTEIGRVPSHLAYRTRNALDNLMMLHTSEHGGRAYRHAVEELPETMETLLLLGLMILLTGGAMLFLISGKGIGKTSIGLICVIVSSGMLWMADVPLQWIASAIVLEFFMMVLLIPEPEKQRTPQDNQLAYVVIGILTLAAIVAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLVTHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGRRGTGSQGETLGEKWKKKLNQLSRKEFDLYKKSGITEVDRTEAKEGLKRGETTHHAVSRGSAKLQWFVERNMVIPEGRVIDLGCGRGGWSYYCAGLKKVTEVRGYTKGGPGHEEPVPMSTYGWNLVKLMSGKDVFYLPPEKCDTLLCDIGESSPSPTVEESRTIRVLKMVEPWLKNNQFCIKVLNPYMPTVIEHLERLQRKYGGMLVRNPLSRNSTHEMYWISNGTGNIVSSVNMVSRLLLNRFTMTHRRPTIEKDVDLGAGTRHVNAEPETPNMDVIGERIKRIKEEHSSTWHYDDENPYKTWAYHGSYEVKATGSASSMINGVVKLLTKPWDVVPMVTQMAMTDTTPFGQQRVFKEKVDTRTPRPMPGTRKVMEITAEWLWRTLGRNKKPRLCTREEFTKKVRTNAAMGAVFTEENQWDSARAAVEDEEFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPKGTVMDIISRKDQRGSGQVGTYGLNTFTNMEAQLVRQMEGEGVLSKADLENPHLLEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLKETACLGKAYAQMWSLMYFHRRDLRLASNAICSAVPVHWIPTSRTTWSIHAHHQWMTTEDMLTVWNRVWIEDNPWMEDKTPVTTWEDVPYLGKREDQWCGSLIGLTSRATWAQNILTAIQQVRSLIGDEEFLDYMPSMKRFRKEEESEGAIW

SEQ ID NO: 5051 - protein, 3290 aa, Artificial Sequence
  derived and/or modified protein sequence (wt) from DENV-3__FJ562102__SS-prME
TSLCLMMMLPATLAFHLTSRDGEPRMIVGKNERGKSLLFKTASGINMCTLIAMDLGEMCDDTVTYKCPLIAEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAILPEEQDQNYVCKHTYVDRGWGNGCGLFGKGSLVTCAKFQCLEPIEGKVVQYENLKYTVIITVHTGDQHQVGNDTQGVTVEITPQASTVEAVLPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCLNTFVLKKEVSETQHGTILIKVEYKGEDAPCKIPFSTEDGQGKAHNGRLITANPVVTKKEEPVNIEAEPPFGESNIVIGIGDKALKINWYKKGSSIGKMFEATARGARRMAILGDTAWDFGSVGGVLNSLGKMVHQIFGSAYTALFSGVSWIMKIGIGVLLTWIGLNSKNTSMSFSCIVIGIITLYLGAVVQADMGCAINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSASRAWNVWEVEDYGFGVFTTNIWLKLREVYTQSCDHRLMSAAIKDERAVHADMGYWIESQKNGSWKLEKASFIEVKTCTWPKSHTLWSNGVLESDMIIPKSLAGPISQHNHRPGYHTQTAGPWHLGKLELDFNYCEGTTVVITENCGTRGPSLRTTTVSGKLIHEWCCRSCTLPPLRYMGEDGCWYGMEIRPINEKEENMVKSLVSAGSGKVDNFTMGVLCLAILFEEVMRGKFGKKHMIAGVLFTFVLLLSGQITWRDMAHTFIMIGSNASDRMGMGVTYLALIATFKIQPFLALGFFLRKLTSRENLLLGVGLAMATTLQLPEDIEQMANGIALGLMTLKLITQFETYQLWTALVSLTCSNTIFTLTVAWRTATLILAGVSLLPLCQSSSMRKTDWLPMTVAAMGVPPLPLFIFSLKDTPKRRSWPLNEGVMAVGLVSILASSLLRNDVPMAGPLVAGGLLIACYVITGTSADLTVEKAADVTWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTHNGKRLEPNWASVKKDLISYGGGWRLSAQWQKGEEVQVIAVEPGKNPKNFQTMPGIFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTAEAFPQSNAPIQDEERDIPERSWNSGNEWITDFVGKTVWFVPSIKAGNDIANCLRKNGKKVIQLSRKTFDTEYQKTRLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGERNNQILEENMDVEIWTKEGERKKLRPRWLDARTYSDPLALKEFKDFAAGRKSIALDLVTEIGRVPSHLAYRTRNALDNLVMLHTSEHGGRAYRHAVEELPETMETLLLLGLMILLTGGAMLFLISGKGIGKTSIGLICVIVSSGMLWMADVPLQWIASAIILEFFMMVLLIPEPEKQRTPQDNQLAYVVIGILTLAAIVAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLVTHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGRRGTGSQGETLGEKWKKKLNQLSRKEFDLYKKSGITEVDRTEAKEGLKRGETTHHAVSRGSAKLQWFVERNMVIPEGRVIDLGCGRGGWSYYCAGLKKVTEVRGYTKGGPGHEEPVPMSTYGWNLVKLMSGKDVFYLPPEKCDTLLCDIGESSPSPTVEESRTIRVLKMVEPWLKNNQFCIKVLNPYMPTVIEHLERLQRKYGGMLVRNPLSRNSTHEMYWISNGTGNIVSSVNMVSRLLLNRFTMTHRRPTIEKDVDLGAGTRHVNAEPETPNMDVIGERIKRIKEEHSSTWHYDDENPYKTWAYHGSYEVKATGSASSMINGVVKLLTKPWDVVPMVTQMAMTDTTPFGQQRVFKEKVDTRTPRPMPGTRKVMEITAEWLWRTLGRNKKPRLCTREEFTKKVRTNAAMGAVFTEENQWDSARAAVEDEEFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPKGTVMDIISRKDQRGSGQVGTYGLNTFTNMEAQLVRQMEGEGVLSKADLENPHLLEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLKETACLGKAYAQMWSLMYFHRRDLRLASNAICSAVPVHWIPTSRTTWSIHAHHQWMTTEDMLTVWNRVWIEDNPWMEDKTPVTTWEDVPYLGKREDQWCGSLIGLTSRATWAQNILTAIQQVRSLIGDEEFLDYMPSMKRFRKEEESEGAIW

SEQ ID NO: 5052 - protein, 3290 aa, Artificial Sequence
  derived and/or modified protein sequence (wt) from DENV-3__FJ410229__SS-prME
TSLCLMMMLPATLAFHLTSRDGEPRMIVGKNERGKSLLFKTASGINMCTLIAMDLGEMCDDTVTYKCPLIAEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAILPEEQDQNYVCKHTYVDRGWGNGCGLFGKGSLVTCAKFQCLEPIEGKVVQYENLKYTVIITVHTGDQHQVGNDTQGVTVEITPQASTVEAVLPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCLNTFVLKKEVSETQHGTILIKVEYKGEDAPCKIPFSTEDGQGKAHNGRLITANPVVTKKEEPVNIEAEPPFGESNIVIGIGDKALKINWYKKGSSIGKMFEATARGARRMAILGDTAWDFGSVGGVLNSLGKMVHQIFGSAYTALFSGVSWIMKIGIGVLLTWIGLNSKNTSMSFSCIVIGIITLYLGAVVQADMGCAINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSASRAWNVWEVEDYGFGVFTTNIWLKLREVYTQSCDHRLMSAAIKDERAVHADMGYWIESQKNGSWKLEKASFIEVKTCTWPKSHTLWSNGVLESDMIIPKSLAGPISQHNHRPGYHTQTAGPWHLGKLELDFNYCEGTTVVITENCGTRGPSLRTTTVSGKLIHEWCCRSCTLPPLRYMGEDGCWYGMEIRPINEKEENMVKSLVSAGSGKVDNFTMGVLCLAILFEEVMRGKFGKKHMIAGVLFTFVLLLSGQITWRDMAHTLIMIGSNASDRMGMGVTYLALIATFKIQPFLALGFFLRKLTSRENLLLGVGLAMATTLQLPEDIEQMANGIALGLMTLKLITQFETYQLWTALVSLTCSNTIFTLTVAWRTATLILAGVSLLPLCQSSSMRKTDWLPMTVAAMGVPPLPLFIFSLKDTPKRRSWPLNEGVMAVGLVSILASSLLRNDVPMAGPLVAGGLLIACYVITGTSADLTVEKAADVTWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTHNGKRLEPNWASVKKDLISYGGGWRLSAQWQKGEEVQVIAVEPGKNPKNFQTMPGIFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTAEAFPQSNAPIQDEERDIPERSWNSGNEWITDFVGKTVWFVPSIKAGNDIANCLRKNGKKVIQLSRKTFDTEYQKTRLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGERNNQILEENMDVEIWTKEGERKKLRPRWLDARTYSDPLALKEFKDFAAGRKSIALDLVTEIGRVPSHLAYRTRNALDNLVMLHTSEHGGRAYRHAVEELPETMETLLLLGLMILLTGGAMLFLISGKGIGKTSIGLICVIVSSGMLWMADVPLQWIASAIILEFFMMVLLIPEPEKQRTPQDNQLAYVVIGILTLAAIVAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLVTHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGRRGTGSQGETLGEKWKKKLNQLSRKEFDLYKKSGITEVDRTEAKEGLKRGETTHHAVSRGSAKLQWFVERNMVIPEGRVIDLGCGRGGWSYYCAGLKKVTEVRGYTKGGPGHEEPVPMSTYGWNLVKLMSGKDVFYLPPEKCDTLLCDIGESSPSPTVEESRTIRVLKMVEPWLKNNQFCIKVLNPYMPTVIEHLERLQRKYGGMLVRNPLSRNSTHEMYWISNGTGNIVSSVNMVSRLLLNRFTMTHRRPTIEKDVDLGAGTRHVNAEPETPNMDVIGERIKRIKEEHSSTWHYDDENPYKTWAYHGSYEVKATGSASSMINGVVKLLTKPWDVVPMVTQMAMTDTTPFGQQRVFKEKVDTRTPRPMPGTRKVMEITAEWLWRTLGRNKKPRLCTREEFTKKVRTNAAMGAVFTEENQWDSARAAVEDEEFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPKGTVMDIISRKDQRGSGQVGTYGLNTFTNMEAQLVRQMEGEGVLSKADLENPHLLEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLKETACLGKAYAQMWSLMYFHRRDLRLASNAICSAVPVHWIPTSRTTWSIHAHHQWMTTEDMLTVWNRVWIEDNPWMEDKTPVTTWEDVPYLGKREDQWCGSLIGLTSRATWAQNILTAIQQVRSLIGDEEFLDYMPSMKRFRKEEESEGAIW

SEQ ID NO: 5053 - protein, 3290 aa, Artificial Sequence
  derived and/or modified protein sequence (wt) from DENV-3__FJ461326__SS-prME
TSLCLMMMLPATLAFHLTSRDGEPRMIVGKNERGKSLLFKTASGINMCTLIAMDLGEMCDDTVTYKCPLIAEVEPEDIDCWCNLTSTWVTYGTCNQAGEHRRDKRSVALAPHVGMGLDTRTQTWMSAEGAWRQVEKVETWALRHPGFTILALFLAHYISTSLTQKVVIFILLMLVTPSMTMRCVGVGNRDFVEGLSGATWVDVVLEHGGCVTTMARNKPTLDIELQKTEATQLATLRKLCIEGKITNITTDSRCPTQGEAILPEEQDQNYVCKHTYVDRGWGNGCGLFGKGSLVTCAKFQCLEPIEGKVVQYENLKYTVIITVHTGDQHQVGNDTQGVTVEITPQASTVEAVLPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCLNTFVLKKEVSETQHGTILIKVEYKGEDAPCKIPFSTEDGQGKAHNGRLITANPVVTKKEEPVNIEAEPPFGESNIVIGIGDKALKINWYKKGSSIGKMFEATARGARRMAILGDTAWDFGSVGGVLNSLGKMVHQIFGSAYTALFSGVSWIMKIGIGVLLTWIGLNSKNTSMSFSCIVIGIITLYLGAVVQADMGCAINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSASRAWNVWEVEDYGFGVFTTNIWLKLREVYTQSCDHRLMSAAIKDERAVHADMGYWIESQKNGSWKLEKASFIEVKTCTWPKSHTLWSNGVLESDMIIPKSLAGPISQHNHRPGYHTQTAGPWHLGKLELDFNYCEGTTVVITENCGTRGPSLRTTTVSGKLIHEWCCRSCTLPPLRYMGEDGCWYGMEIRPINEKEENMVKSLVSAGSGKVDNFTMGVLCLAILFEEVMRGKFGKKHMIAGVLFTFVLLLSGQITWRDMAHTLIMIGSNASDRMGMGVTYLALIATFKIQPFLALGFFLRKLTSRENLLLGVGLAMATTLQLPEDIEQMANGIALGLMTLKLITQFETYQLWTALVSLTCSNTIFTLTVAWRTATLILAGVSLLPLCQSSSMRKTDWLPMTVAAMGVPPLPLFIFSLKDTPKRRSWPLNEGVMAVGLVSILASSLLRNDVPMAGPLVAGGLLIACYVITGTSADLTVEKAADVTWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTHNGKRLEPNWASVKKDLISYGGGWRLSAQWQKGEEVQVIAVEPGKNPKNFQTMPGIFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTAEAFPQSNAPIQDEERDIPERSWNSGNEWITDFVGKTVWFVPSIKAGNDIANCLRKNGKKVIQLSRKTFDTEYQKTRLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGERNNQILEENMDVEIWTKEGERKKLRPRWLDARTYSDPLALKEFKDFAAGRKSIALDLVTEIGRVPSHLAYRTRNALDNLVMLHTSEHGGRAYRHAVEELPETMETLLLLGLMILLTGGAMLFLISGKGIGKTSIGLICVIASSGMLWMADVPLQWIASAIILEFFMMVLLIPEPEKQRTPQDNQLAYVVIGILTLAAIVAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLVTHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGRRGTGSQGETLGEKWKKKLNQLSRKEFDLYKKSGITEVDRTEAKEGLKRGETTHHAVSRGSAKLQWFVERNMVIPEGRVIDLGCGRGGWSYYCAGLKKVTEVRGYTKGGPGHEEPVPMSTYGWNLVKLMSGKDVFYLPPEKCDTLLCDIGESSPSPTVEESRTIRVLKMVEPWLKNNQFCIKVLNPYMPTVIEHLERLQRKYGGMLVRNPLSRNSTHEMYWISNGTGNIVSSVNMVSRLLLNRFTMTHRRPTIEKDVDLGAGTRHVNAEPETPNMDVIGERIKRIKEEHSSTWHYDDENPYKTWAYHGSYEVKATGSASSMINGVVKLLTKPWDVVPMVTQMAMTDTTPFGQQRVFKEKVDTRTPRPMPGTRKVMEITAEWLWRTLGRNKKPRLCTREEFTKKVRTNAAMGAVFTEENQWDSARAAVEDEEFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRKLANAIFKLTYQNKVVKVQRPTPKGTVMDIISRKDQRGSGQVGTYGLNTFTNMEAQLVRQMEGEGVLSKADLENPHLLEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLKETACLGKAYAQMWSLMYFHRRDLRLASNAICSAVPVHWIPTSRTTWSIHAHHQWMTTEDMLTVWNRVWIEDNPWMEDKTPVTTWEDVPYLGKREDQWCGSLIGLTSRATWAQNILTAIQQVRSLIGDEEFLDYMPSMKRFRKEEESEGAIW

SEQ ID NO: 5054 - protein, 3290 aa, Artificial Sequence
  derived and/or modified protein sequence (wt) from DENV-3__FJ461329__SS-prME
TSLCLMMMLPATLAFHLTSRDGEPRMIVGKNERGKSLLFKTASGINMCTLIAMDLGEMCDDTVTYKCPLIAEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAILPEEQDQNYVCKHTYVDRGWGNGCGLFGKGSLVTCAKFQCLEPIEGKVVQYENLKYTVIITVHTGDQHQVGNDTQGVTVEITPQASTVEAVLPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCLNTFVLKKEVSETQHGTILIKVEYKGEDAPCKIPFSTEDGQGKAHNGRLITANPVVTKKEEPVNIEAEPPFGESNIVIGIGDKALKINWYKKGSSIGKMFEATARGARRMAILGDTAWDFGSVGGVLNSLGKMVHQIFGSAYTALFSGVSWIMKIGIGVLLTWIGLNSKNTSMSFSCIVIGIITLYLGAVVQADMGCAINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSASRAWNVWEVEDYGFGVFTTNIWLKLREVYTQSCDHRLMSAAIKDERAVHADMGYWIESQKNGSWKLEKASFIEVKTCTWPKSHTLWSNGVLESDMIIPKSLAGPISQHNHRPGYHTQTAGPWHLGKLELDFNYCEGTTVVITEDCGTRGPSLRTTTVSGKLIHEWCCRSCTLPPLRYMGEDGCWYGMEIRPINEKEENMVKSLVSAGSGKVDNFTMGVLCLAILFEEVMRGKFGKKHMIAGVLFTFVLLLSGQITWRDMAHTLIMIGSNASDRMGMGVTYLALIATFKIQPFLALGFFLRKLTSRENLLLGVGLAMATTLQLPEDIEQMANGIALGLMTLKLITQFETYQLWTALVSLTCSNTIFTLTVAWRTATLILAGVSLLPLCQSSSMRKTDWLPMTVAAMGVPPLPLFIFSLKDTPKRRSWPLNEGVMAVGLVSILASSLLRNDVPMAGPLVAGGLLIACYVITGTSADLTVEKAADVTWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTHNGKRLEPNWASVKKDLISYGGGWRLSAQWQKGEEVQVIAVEPGKNPKNFQTMPGIFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTAEAFPQSNAPIQDEERDIPERSWNSGNEWITDFVGKTVWFVPSIKAGNDIANCLRKNGKKVIQLSRKTFDTEYQKTRLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGERNNQILEENMDVEIWTKEGERKKLRPRWLDARTYSDPLALKEFKDFAAGRKSIALDLVTEIGRVPSHLAYRTRNALDNLVMLHTSEHGGRAYRHAVEELPETMETLLLLGLMILLTGGAMLFLISGKGIGKTSIGLICVIVSSGMLWMADIPLQWIASAIVLEFFMMVLLIPEPEKQRTPQDNQLAYVVIGILTLAAIVAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLVTHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGRRGTGSQGETLGEKWKKKLNQLSRKEFDLYKKSGITEVDRTEAKEGLKRGETTHHAVSRGSAKLQWFVERNMVIPEGRVIDLGCGRGGWSYYCAGLKKVTEVRGYTKGGPGHEEPVPMSTYGWNLVKLMSGKDVFYLPPEKCDTLLCDIGESSPSPTVEESRTIRVLKMVEPWLKNNQFCIKVLNPYMPTVIEHLERLQRKYGGMLVRNPLSRNSTHEMYWISNGTGNIVSSVNMVSRLLLNRFTMTHRRPTIEKDVDLGAGTRHVNAEPETPNMDVIGERIKRIKEEHSSTWHYDDENPYKTWAYHGSYEVKATGSASSMINGVVKLLTKPWDVVPMVTQMAMTDTTPFGQQRVFKEKVDTRTPRPMPGTRKVMEITAEWLWRTLGRNKKPRLCTREEFTKKVRTNAAMGAVFTEENQWDSARAAVEDEEFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPKGTVMDIISRKDQRGSGQVGTYGLNTFTNMEAQLVRQMEGEGVLSKADLENPHLLEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLKETACLGKAYAQMWSLMYFHRRDLRLASNAICSAVPVHWIPTSRTTWSIHAHHQWMTTEDMLTVWNRVWIEDNPWMEDKTPVTTWEDVPYLGKREDQWCGSLIGLTSRATWAQNILTAIQQVRSLIGNEEFLDYMPSMKRFRKEEESEGAIW

SEQ ID NO: 5055 - protein, 3290 aa, Artificial Sequence
  derived and/or modified protein sequence (wt) from DENV-3__KF955459__SS-prME
TSLCLMMMLPATLAFHLTSRDGEPRMIVGKNERGKSLLFKTASGINMCTLIAMDLGEMCDDTVTYKCPLIAEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAILPEEQDQNYVCKHTYVDRGWGNGCGLFGKGSLVTCAKFQCLEPIEGKVVQYENLKYTVIITVHTGDQHQVGNDTQGVTVEITPQASTVEAVLPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCLNTFVLKKEVSETQHGTILIKVEYKGEDAPCKIPFSTEDGQGKAHNGRLITANPVVTKKEEPVNIEAEPPFGESNIVIGIGDKALKINWYKKGSSIGKMFEATARGARRMAILGDTAWDFGSVGGVLNSLGKMVHQIFGSAYTALFSGVSWIMKIGIGVLLTWIGLNSKNTSMSFSCIVIGIITLYLGAVVQADMGCAINWKGKELKCGSGIFVTNEVHTWTEQYKFQADSPKRLATAIAGAWENGVCGIRSATRMENLLWKQIANELNYILWENNIKLTVVVGDIIGVLEQGKRTLTPQPMELKYSWKTWGKAKIVTAETQNSSFIIDGPNTPECPSASRAWNVWEVEDYGFGVFTTNIWLKLREVYTQSCDHRLMSAAIKDERAVHADMGYWIESQKNGSWKLEKASFIEVKTCTWPKSHTLWSNGVLESDMIIPKSLAGPISQHNHRPGYHTQTAGPWHLGKLELDFNYCEGTTVVITENCGTRGPSLRTTTVSGKLIHEWCCRSCTLPPLRYMGEDGCWYGMEIRPINEKEENMVKSLVSAGSGKVDNFTMGVLCLAILFEEVMRGKFGKKHMIAGVLFTFVLLLSGQITWRDMAHTLIMIGSNASDRMGMGVTYLALIATFKIQPFLALGFFLRKLTSRENLLLGVGLAMATTLQLPEDIEQMANGIALGLMTLKLITQFETYQLWTALVSLTCSNTIFTLTVAWRTATLILAGVSLLPLCQSSSMRKTDWLPMTVAAMGVPPLPLFIFSLKDTPKRRSWPLNEGVMAVGLVSILASSLLRNDVPMAGPLVAGGLLIACYVITGTSADLTVEKAADVTWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTHNGKRLEPNWASVKKDLISYGGGWRLSAQWQKGEEVQVIAVEPGKNPKNFQTMPGIFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTAEAFPQSNAPIQDEERDIPERSWNSGNEWITDFVGKTVWFVPSIKAGNDIANCLRKNGKKVIQLSRKTFDTEYQKTRLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGERNNQILEENMDVEIWTKEGERKKLRPRWLDARTYSDPLALKEFKDFAAGRKSIALDLVTEIGRVPSHLAYRTRNALDNLVMLHTSEHGGRAYRHAVEELPETMETLLLLGLMILLTGGAMLFLISGKGIGKTSIGLICVIVSSGMLWMADVPLQWIASAIILEFFMMVLLIPEPEKQRTPQDNQLAYVVIGILTLAAIVAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLVTHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGRRGTGSQGETLGEKWKKKLNQLSRKEFDLYKKSGITEVDRTEAKEGLKRGETTHHAVSRGSAKLQWFVERNMVIPEGRVIDLGCGRGGWSYYCAGLKKVTEVRGYTKGGPGHEEPVPMSTYGWNLVKLMSGKDVFYLPPEKCDTLLCDIGESSPSPTVEESRTIRVLKMVEPWLKNNQFCIKVLNPYMPTVIEHLERLQRKYGGMLVRNPLSRNSTHEMYWISNGTGNIVSSVNMVSRLLLNRFTMTHRRPTIEKDVDLGAGTRHVNAEPETPNMDVIGERIKRIKEEHSSTWHYDDENPYKTWAYHGSYEVKATGSASSMINGVVKLLTKPWDVVPMVTQMAMTDTTPFGQQRVFKEKVDTRTPRPMPGTRKVMEITAEWLWRTLGRNKKPRLCTREEFTKKVRTNAAMGAVFTEENQWDSARAAVEDEEFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPKGTVMDIISRKDQRGSGQVGTYGLNTFTNMEAQLVRQMEGEGVLSKADLENPHLLEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLKETACLGKAYAQMWSLMYFHRRDLRLASNAICSAVPVHWIPTSRTTWSIHAHHQWMTTEDMLTVWNRVWIEDNPWMEDKTPVTTWEDVPYLGKREDQWCGSLIGLTSRATWAQNILTAIQQVRSLIGDEEFLDYMPSMKRFRKEEESEGAIW

SEQ ID NO: 5056 - protein, 3290 aa, Artificial Sequence
  derived and/or modified protein sequence (wt) from DENV-3__FJ547066__SS-prME
TSLCLMMMLPATLAFHLTSRDGEPRMIVGKNERGKSLLFKTASGINMCTLIAMDLGEMCDDTVTYKCPLIAEMEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAILPEEQDQNYVCKHTYVDRGWGNGCGLFGKGSLVTCAKFQCLEPIEGKVVQYENLKYTVIITVHTGDQHQVGNDTQGVTVEITPQASTVEAVLPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCLNTFVLKKEVSETQHGTILIKVEYKGEDAPCKIPFSTEDGQGKAHNGRLITANPVVTKKEEPVNIEAEPPFGESNIVIGIGDKALKINWYKKGSSIGKMFEATARGARRMAILGDTAWDFGSVGGVLNSLGKMVHQIFGSAYTALFSGVSWIMKIGIGVLLTWIGLNSKNTSMSFSCIVIGIITLYLGAVVQADMGCAINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSASRAWNVWEVEDYGFGVFTTNIWLKLREVYTQSCDHRLMSAAIKDERAVHADMGYWIESQKNGSWKLEKASFIEVKTCTWPKSHTLWSNGVLESDMIIPKSLAGPISQHNHRPGYHTQTAGPWHLGKLELDFNYCEGTTVVITENCGTRGPSLRTTTVSGKLIHEWCCRSCTLPPLRYMGEDGCWYGMEIRPINEKEENMVKSLVSAGSGKVDNFTMGVLCLAILFEEVMRGKFGKKHMIAGVLFTFVLLLSGQITWRDMAHTLIMIGSNASDRMGMGVTYLALIATFKIQPFLALGFFLRKLTSRENLLLGVGLAMATTLQLPEDIEQMANGIALGLMTLKLITQFETYQLWTALVSLTCSNTIFTLTVAWRTATLILAGVSLLPLCQSSSMRKTDWLPMTVAAMGVPPLPLFIFSLKDTPKRRSWPLNEGVMAVGLVSILASSLLRNDVPMAGPLVAGGLLIACYVITGTSADLTVEKAADVTWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTHNGKRLEPNWASVKKDLISYGGGWRLSAQWQKGEEVQVIAVEPGKNPKNFQTMPGIFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTAEAFPQSNAPIQDEERDIPERSWNSGNEWITDFVGKTVWFVPSIKAGNDIANCLRKNGKKVIQLSRKTFDTEYQKTRLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGERNNQILEENMDVEIWTKEGERKKLRPRWLDARTYSDPLALKEFKDFAAGRKSIALDLVTEIGRVPSHLAYRTRNALDNLVMLHTSEHGGRAYRHAVEELPETMETLLLLGLMILLTGGAMLFLISGKGIGKTSIGLICVIVSSGMLWMADVPLQWIASAIILEFFMMVLLIPEPEKQRTPQDNQLAYVVIGILTLAAIVAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLVTHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGRRGTGSQGETLGEKWKKKLNQLSRKEFDLYKKSGITEVDRTEAKEGLKRGETTHHAVSRGSAKLQWFVERNMVIPEGRVIDLGCGRGGWSYYCAGLKKVTEVRGYTKGGPGHEEPVPMSTYGWNLVKLMSGKDVFYLPPEKCDTLLCDIGESSPSPTVEESRTIRVLKMVEPWLKNNQFCIKVLNPYMPTVIEHLERLQRKYGGMLVRNPLSRNSTHEMYWISNGTGNIVSSVNMVSRLLLNRFTMTHRRPTIEKDVDLGAGTRHVNAEPETPNMDVIGERIKRIKEEHSSTWHYDDENPYKTWAYHGSYEVKATGSASSMINGVVKLLTKPWDVVPMVTQMAMTDTTPFGQQRVFKEKVDTRTPRPMPGTRKVMEITAEWLWRTLGRNKKPRLCTREEFTKKVRTNAAMGAVFTEENQWDSARAAVEDEGFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPKGTVMDIISRKDQRGSGQVGTYGLNTFTNMEAQLVRQMEGEGVLSKADLENPHLLEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLKETACLGKAYAQMWSLMYFHRRDLRLASNAICSAVPVHWIPTSRTTWSIHAHHQWMTTEDMLTVWNRVWIEDNPWMEDKTPVTTWEDVPYLGKREDQWCGSLIGLTSRATWAQNILTAIQQVRSLIGDEEFLDYMPSMKRFRKEEESEGAIW

SEQ ID NO: 5057 - protein, 3290 aa, Artificial Sequence
  derived and/or modified protein sequence (wt) from DENV-3__KF955460__SS-prME
TSLCLMMMLPATLAFHLTSRDGEPRMIVGKNERGKSLLFKTASGINMCTLIAMDLGEMCDDTVTYKCPLIAEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFTLLMLVTPSMTMRCVGVGNRDFVEGLSGATWVDVVLEHGGCVTTMAKNKPTLDIELQKTEATQLATLRKLCIEGKITNITTDSRCPTQGEAILPEEQDQNYVCKHTYVDRGWGNGCGLFGKGSLVTCAKFQCLEPIEGKVVQYENLKYTVIITVHTGDQHQVGNDTQGVTVEITPQASTVEAVLPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCLNTFVLKKEVSETQHGTILIKVEYKGEDAPCKIPFSTEDGQGKAHNGRLITANPVVTKKEEPVNIEAEPPFGESNIVIGIGNKALKINWYKKGSSIGKMFEATARGARRMAILGDTAWDFGSVGGVLNSLGKMVHQIFGSAYTALFSGVSWIMKIGIGVLLTWIGLNSKNTSMSFSCIVIGIITLYLGAVVQADMGCAINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSASRAWNVWEVEDYGFGVFTTNIWLKLREVYTQSCDHRLMSAAIKDERAVHADMGYWIESQKNGSWKLEKASFIEVKTCTWPKSHTLWSNGVLESDMIIPKSLAGPISQHNHRPGYHTQTAGPWHLGKLELDFNYCEGTTVVITENCGTRGPSLRTTTVSGKLIHEWCCRSCTLPPLRYMGEDGCWYGMEIRPINEKEENMVKSLVSAGSGKVDNFTMGVLCLAILFEEVMRGKFGKKHMIAGVLFTFVLLLSGQITWRDMAHTLIMIGSNASDRMGMGVTYLALIATFKIQPFLALGFFLRKLTSRENLLLGVGLAMATTLQLPEDIEQMANGIALGLMTLKLITQFETYQLWTALVSLTCSNTIFTLTVAWRTATLILAGVSLLPLCQSSSMRKTDWLPMTVAAMGVPPLPLFIFSLKDTPKRRSWPLNEGVMAVGLVSILASSLLRNDVPMAGPLVAGGLLIACYVITGTSADLTVEKAADVTWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTHNGKRLEPNWASVKKDLISYGGGWRLSAQWQKGEEVQVIAVEPGKNPKNFQTMPGIFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTAEAFPQSNAPIQDEEKDIPERSWNSGNEWITDFVGKTVWFVPSIKAGNDIANCLRKNGKKVIQLSRKTFDTEYQKTRLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGERNNQILEENMDVEIWTKEGERKKLRPRWLDARTYSDPLALKEFKDFAAGRKSIALDLVTEIGRVPSHLAYRTRNALDNLVMLHTSEHGGRAYRHAVEELPETMETLLLLGLMILLTGGAMLFLISGKGIGKTSIGLICVIVSSGMLWMADVPLQWIASAIVLEFFMMVLLIPEPEKQRTPQDNQLAYVVIGILTLAAIVAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLVTHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGRRGTGSQGETLGEKWKKKLNQLSRKEFDLYKKSGITEVDRTEAKEGLKRGETTHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKYGGMLVRNPLSRNSTHEMYWISNGTGNIVSSVNMVSRLLLNRFTMTHRRPTIEKDVDLGAGTRHVNAEPETPNMDVIGERIKRIKEEHSSTWHYDDENPYKTWAYHGSYEVKATGSASSMINGVVKLLTKPWDVVPMVTQMAMTDTTPFGQQRVFKEKVDTRTPRPMPGTRKVMEITAEWLWRTLGRNKKPRLCTREEFTKKVRTNAAMGAVFTEENQWDSARAAVEDEEFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPKGTVMDIISRKDQRGSGQVGTYGLNTFTNMEAQLVRQMEGEGVLSKADLENPHLLEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLKETACLGKAYAQMWSLMYFHRRDLRLASNAICSAVPVHWIPTSRTTWSIHAHHQWMTTEDMLTVWNRVWIEDNPWMEDKTPVTTWEDIPYLGKREDQWCGSLIGLTSRATWAQNILTAIQQVRSLIGDEEFLDYMPSMKRFRKEEESEGAIW

SEQ ID NO: 5058 - protein, 3290 aa, Artificial Sequence
  derived and/or modified protein sequence (wt) from DENV-3__FJ461334__SS-prME
TSLCLMMMLPATLAFHLTSRDGEPRMIVGKNERGKSLLFKTASGINMCTLIAMDLGEMCDDTVTYKCPLIAEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAILPEEQDQNYVCKHTYVDRGWGNGCGLFGKGSLVTCAKFQCLEPIEGKVVQYENLKYTVIITVHTGDQHQVGNDTQGVTVEITPQASTVEAVLPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCLNTFVLKKEVSETQHGTILIKVEYKGEDAPCKIPFSTEDGQGKAHNGRLITANPVVTKKEEPVNIEAEPPFGESNIVIGIGDKALKINWYKKGSSIGKMFEATARGARRMAILGDTAWDFGSVGGVLNSLGKMVHQIFGSAYTALFSGVSWIMKIGIGVLLTWIGLNSKNTSMSFSCIVIGIITLYLGAVVQADMGCAINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSASRAWNVWEVEDYGFGVFTTNIWLKLREVYTQSCDHRLMSAAIKDERAVHADMGYWIESQKNGSWKLEKASFIEVKTCTWPKSHTLWSNGVLESDMIIPKSLAGPISQHNHRPGYHTQTAGPWHLGKLELDFNYCEGTTVVITENCGTRGPSLRTTTVSGKLIHEWCCRSCTLPPLRYMGEDGCWYGMEIRPINEKEENMVKSLVSAGSGKVDNFTMGVLCLAILFEEVMRGKFGKKHMIAGVLFTFVLLLSGQITWRDMAHTLIMIGSNASDRMGMGVTYLALIATFKIQPFLALGFFLRKLTSRENLLLGVGLAMATTLQLPEDIEQMANGIALGLMTLKLITQFETYQLWTALVSLTCSNTIFTLTVAWRTATLILAGVSLLPLCQSSSMRKTDWLPMTVAAMGVPPLPLFIFSLKDTPKRRSWPLNEGVMAVGLVSILASSLLRNDVPMAGPLVAGGLLIACYVITGTSADLTVEKAADVTWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTHNGKRLEPNWASVKKDLISYGGGWRLSTQWQKGEEVQVIAVEPGKNPKNFQTMPGIFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTAEAFPQSNAPIQDEERDIPERSWNSGNEWITDFVGKTVWFVPSIKAGNDIANCLRKNGKKVIQLSRKTFDTEYQKTRLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGERNNQILEENMDVEIWTKEGERKKLRPRWLDARTYSDPLALKEFKDFAAGRKSIALDLVTEIGRVPSHLAYRTRNALDNLVMLHTSEHGGRAYRHAVEELPETMETLLLLGLMILLTGGAMLFLISGKGIGKTSIGLICVIVSSGMLWMADVPLQWIASAIILEFFMMVLLIPEPEKQRTPQDNQLAYVVIGILTLAAIVAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLVTHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGRRGTGSQGETLGEKWKKKLNQLSRKEFDLYKKSGITEVDRTEAKEGLKRGETTHHAVSRGSAKLQWFVERNMVIPEGRVIDLGCGRGGWSYYCAGLKKVTEVRGYTKGGPGHEEPVPMSTYGWNLVKLMSGKDVFYLPPEKCDTLLCDIGESSPSPTVEESRTIRVLKMVEPWLKNNQFCIKVLNPYMPTVIEHLERLQRKYGGMLVRNPLSRNSTHEMYWISNGTGNIVSSVNMVSRLLLNRFTMTHRRPTIEKDVDLGAGTRHVNAEPETPNMDVIGERIKRIKEEHSSTWHYDDENPYKTWAYHGSYEVKATGSASSMINGVVKLLTKPWDVVPMVTQMAMTDTTPFGQQRVFKEKVDTRTPRPMPGTRKVMEITAEWLWRTLGRNKKPRLCTREEFTKKVRTNAAMGAVFTEENQWDSARAAVEDEEFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPKGTVMDIISRKDQRGSGQVGTYGLNTFTNMEAQLVRQMEGEGVLSKADLENPHLLEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLKETACLGKAYAQMWSLMYFHRRDLRLASNAICSAVPVHWIPTSRTTWSIHAHHQWMTTEDMLTVWNRVWIEDNPWMEDKTPVTTWEDVPYLGKREDQWCGSLIGLTSRATWAQNILTAIQQVRSLIGDEEFLDYMPSMKRFRKEEESEGAIW

SEQ ID NO: 5059 - protein, 3290 aa, Artificial Sequence
  derived and/or modified protein sequence (wt) from DENV-3__FJ461337__SS-prME
TSLCLMMMLPATLAFHLTSRDGEPRMIVGKNERGKSLLFKTASGINMCTLIAMDLGEMCDDTVTYKCPLIAEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAILPEEQDQNYVCKHTYVDRGWGNGCGLFGKGSLVTCAKFQCLEPIEGKVVQYENLKYTVIITVHTGDQHQVGNDTQGVTVEITPQASTVEAVLPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCLNTFVLKKEVSETQHGTILIKVEYKGEDAPCKIPFSTEDGQGKAHNGRLITANPVVTKKEEPVNIEAEPPFGESNIVIGIGDKALKINWYKKGSSIGKMFEATARGARRMAILGDTAWDFGSMGGVLNSLGKMVHQIFGSAYTALFSGVSWIMKIGIGVLLTWIGLNSKNTSMSFSCIVIGIITLYLGAVVQADMGCAINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSASRAWNVWEVEDYGFGVFTTNIWLKLREVYTQSCDHRLMSAAIKDERAVHADMGYWIESQKNGSWKLEKASFIEVKTCTWPKSHTLWSNGVLESDMIIPKSLAGPISQHNHRPGYHTQTAGPWHLGKLELDFNYCEGTTVVITEDCGTRGPSLRTTTVSGKLIHEWCCRSCTLPPLRYMGEDGCWYGMEIRPINEKEENMVKSLVSAGSGKVDNFTMGVLCLAILFEEVMRGKFGKKHMIAGVLFTFVLLLSGQITWRDMAHTLIMIGSNASDRMGMGVTYLALIATFKIQPFLALGFFLRKLTSRENLLLGVGLAMATTLQLPEDIEQMANGIALGLMTLKLITQFETYQLWTALVSLTCSNTIFTLTVAWRTATLILAGVSLLPLCQSSSMRKTDWLPMTVAAMGVPPLPLFIFSLKDTPKRRSWPLNEGVMAVGLVSILASSLLRNDVPMAGPLVAGGLLIACYVITGTSADLTVEKAADVTWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTHNGKRLEPNWASVKKDLISYGGGWRLSAQWQKGEEVQVIAVEPGKNPKNFQTMPGIFQTTAGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTAEAFPQSNAPIQDEERDIPERSWNSGNEWITDFVGKTVWFVPSIKAGNDIANCLRKNGKKVIQLSRKTFDTEYQKTRLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGERNNQILEENMDVEIWTKEGERKKLRPRWLDARTYSDPLALKEFKDFAAGRKSIALDLVTEIGRVPSHLAYRTRNALDNLVMLHTSEHGGRAYRHAVEELPETMETLLLLGLMILLTGGAMLFLISGKGIGKTSIGLICVIVSSGMLWMADVPLQWIASAIVLEFFMMVLLIPEPEKQRTPQDNQLAYVVIGILTLAAIVAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLVTHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGRRGTGSQGETLGEKWKKKLNQLSRKEFDLYKKSGITEVDRTEAKEGLKRGETTHHAVSRGSAKLQWFVERNMVIPEGRVIDLGCGRGGWSYYCAGLKKVTEVRGYTKGGPGHEEPVPMSTYGWNLVKLMSGKDVFYLPPEKCDTLLCDIGESSPSPTVEESRTIRVLKMVEPWLKNNQFCIKVLNPYMPTVIEHLERLQRKYGGMLVRNPLSRNSTHEMYWISNGTGNIVSSVNMVSRLLLNRFTMTHRRPTIEKDVDLGAGTRHVNAEPETPNMDVIGERIKRIKEEHSSTWHYDDENPYKTWAYHGSYEVKATGSASSMINGVVKLLTKPWDVVPMVTQMAMTDTTPFGQQRVFKEKVDTRTPRPMPGTRKVMEITAEWLWRTLGRNKKPRLCTREEFTKKVRTNAAMGAVFTEENQWDSARAAVEDEEFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPKGTVMDIISRKDQRGSGQVGTYGLNTFTNMEAQLVRQMEGEGVLSKADLENPHLLEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLKETACLGKAYAQMWSLMYFHRRDLRLASNAICSAVPVHWIPTSRTTWSIHAHHQWMTTEDMLTVWNRVWIEDNPWMEDKTPVTTWEDVPYLGKREDQWCGSLIGLTSRATWAQNILTAIQQVRSLIGDEEFLDYMPSMKRFRKEEESEGAIW

SEQ ID NO: 5060 - protein, 3290 aa, Artificial Sequence
  derived and/or modified protein sequence (wt) from DENV-3__FJ461338__SS-prME
TSLCLMMMLPATLAFHLTSRDGEPRMIVGKNERGKSLLFKTASGINMCTLIAMDLGEMCDDTVTYKCPLVAEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAILPEEQDQNYVCKHTYVDRGWGNGCGLFGKGSLVTCAKFQCLEPIEGKVVQYENLKYTVIITVHTGDQHQVGNDTQGVTVEITPQASTVEAVLPEYGTLGLECSPRTGLDFNEMILLTMKNKAWMVHRQWFFDLPLPWTSGATTETPTWNKKELLVTFKNAHAKKQEVVVLGSQEGAMHTALTGATEIQNSGGTSIFAGHLKCRLKMDKLELKGMSYAMCLNTFVLKKEVSETQHGTILIKVEYKGEDAPCKIPFSTEDGQGKAHNGRLITANPVVTKKEEPVNIEAEPPFGESNIVIGIGDKALKINWYKKGSSIGKMFEATARGARRMAILGDTAWDFGSVGGVLNSLGKMVHQIFGSAYTALFSGVSWIMKIGIGVLLTWIGLNSKNTSMSFSCIVIGIITLYLGAVVQADMGCAINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSASRAWNVWEVEDYGFGVFTTNIWLKLREVYTQSCDHRLMSAAIKDERAVHADMGYWIESQKNGSWKLEKASFIEVKTCTWPKSHTLWSNGVLESDMIIPKSLAGPISQHNHRPGYHTQTAGPWHLGKLELDFNYCEGTTVVITENCGTRGPSLRTTTVSGKLIHEWCCRSCTLPPLRYMGEDGCWYGMEIRPINEKEENMVKSLVSAGSGKVDNFTMGVLCLAILFEEVMRGKFGKKHMIAGVLFTFVLLLSGQITWRDMAHTLIMIGSNASDRMGMGVTYLALIATFKIQPFLALGFFLRKLTSRENLLLGVGLAMATTLQLPEDIEQMANGIALGLMTLKLITQFETYQLWTALVSLTCSNTIFTLTVAWRTATLILAGVSLLPLCQSSSMRKTDWLPMTVAAMGVPPLPLFIFSLKDTPKRRSWPLNEGVMAVGLVSILASSLLRNDVPMAGPLVAGGLLIACYVITGTSADLTVEKAADVTWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTHNGKRLEPNWASVKKDLISYGGGWRLSAQWQKGEEVQVIAVEPGKNPKNFQTMPGIFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTAEAFPQSNAPIQDEERDIPERSWNSGNEWITDFVGKTVWFVPSIKAGNDIANCLRKNGKKVIQLSRKTFDTEYQKTRLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGERNNQILEENMDVEIWTKEGERKKLRPRWLDARTYSDPLALKEFKDFAAGRKSIALDLVTEIGRVPSHLAYRTRNALDNLVMLHTSEHGGRAYRHAVEELPETMETLLLLGLMILLTGGAMLFLISGKGIGKTSIGLICVIVSSGMLWMADVPLQWIASAIVLEFFMMVLLIPEPEKQRTPQDNQLAYVVIGILTLAAIVAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLVTHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGRRGTGSQGETLGEKWKKKLNQLSRKEFDLYKKSGITEVDRTEAKEGLKRGETTHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKYGGMLVRNPLSRNSTHEMYWISNGTGNIVSSVNMVSRLLLNRFTMTHRRPTIEKDVDLGAGTRHVNAEPETPNMDVIGERIKRIKEEHSSTWHYDDENPYKTWAYHGSYEVKATGSASSMINGVVKLLTKPWDVVPMVTQMAMTDTTPFGQQRVFKEKVDTRTPRPMPGTRKVMEITAEWLWRTLGRNKKPRLCTREEFTKKVRTNAAMGAVFTEENQWDSARAAVEDEEFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPKGTVMDIISRKDQRGSGQVGTYGLNTFTNMEAQLVRQMEGEGVLSKADLENPHLLEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLKETACLGKAYAQMWSLMYFHRRDLRLASNAICSAVPVHWIPTSRTTWSIHAHHQWMTTEDMLTVWNRVWIEDNPWMEDKTPVTTWEDVPYLGKREDQWCGSLIGLTSRATWAQNILTAIQQVRSLIGDEEFLDYMPSMKRFRKEEESEGAIW

SEQ ID NO: 5061 - protein, 3290 aa, Artificial Sequence
  derived and/or modified protein sequence (wt) from DENV-3__FJ562103__SS-prME
TSLCLMMMLPATLAFHLTSRDGEPRMIVGKNERGKSLLFKTASGINMCTLIAMDLGEMCDDTVTYRCPLIAEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFTLLMLVTPSMTMRCVGVGNRDFVEGLSGATWVDVVLEHGGCVTTMAKNKPTLDIELQKTEATQLATLRKLCIEGKITNITTDSRCPTQGEAILPEEQDQNYVCKHTYVDRGWGNGCGLFGKGSLVTCAKFQCLEPIEGKVVQYENLKYTVIITVHTGDQHQVGNDTQGVTVEITPQASTVEAVLPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCLNTFVLKKEVSETQHGTILIKVEYKGEDAPCKIPFSTEDGQGKAHNGRLITANPVVTKKEEPVNIEAEPPFGESNIVIGIGNKALKINWYKKGSSIGKMFEATARGARRMAILGDTAWDFGSVGGVLNSLGKMVHQIFGSAYTALFSGVSWIMKIGIGVLLTWIGLNSKNTSMSFSCIVIGIITLYLGAVVQADMGCAINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSASRAWNVWEVEDYGFGVFTTNIWLKLREVYTQSCDHRLMSAAIKDERAVHADMGYWIESQKNGSWKLEKASFIEVKTCTWPKSHTLWSNGVLESDMIIPKSLAGPISQHNHRPGYHTQTAGPWHLGKLELDFNYCEGTTVVITENCGTRGPSLRTTTVSGKLIHEWCCRSCTLPPLRYMGEDGCWYGMEIRPINEKEENMVKSLVSAGSGKVDNFTMGVLCLAILFEEVMRGKFGKKHMIAGVLFTFVLLLSGQITWRDMAHTLIMIGSNASDRMGMGVTYLALIATFKIQPFLALGFFLRKLTSRENLLLGVGLAMATTLQLPEDIEQMANGIALGLMTLKLITQFETYQLWTALVSLTCSNTIFTLTVAWRTATLILAGVSLLPLCQSSSMRKTDWLPMTVAAMGVPPLPLFIFSLKDTPKRRSWPLNEGVMAVGLVSILASSLLRNDVPMAGPLVAGGLLIACYVITGTSADLTVEKAADVTWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTHNGKRLEPNWASVKKDLISYGGGWRLSAQWQKGEEVQVIAVEPGKNPKNFQTMPGIFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTAEAFPQSNAPIQDEEKDIPERSWNSGNEWITDFVGKTVWFVPSIKAGNDIANCLRKNGKKVIQLSRKTFDTEYQKTRLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGERNNQILEENMDVEIWTKEGERKKLRPRWLDARTYSDPLALKEFKDFAAGRKSIALDLVTEIGRVPSHLAYRTRNALDNLVMLHTSEHGGRAYRHAVEELPETMETLLLLGLMILLTGGAMLFLISGKGIGKTSIGLICVIVSSGMLWMADVPLQWIASAIVLEFFMMVLLIPEPEKQRTPQDNQLAYVVIGILTLAAIVAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLVTHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGRRGTGSQGETLGEKWKKKLNQLSRKEFDLYKKSGITEVDRTEAKEGLKRGETTHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKYGGMLVRNPLSRNSTHEMYWISNGTGNIVSSVNMVSRLLLNRFTMTHRRPTIEKDVDLGAGTRHVNAEPETPNMDVIGERIKRIKEEHSSTWHYDDENPYKTWAYHGSYEVKATGSASSMINGVVKLLTKPWDVVPMVTQMAMTDTTPFGQQRVFKEKVDTRTPRPMPGTRKVMEITAEWLWRTLGRNKKPRLCTREEFTKKVRTNAAMGAVFTEENQWDSARAAVEDEEFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPKGTVMDIISRKDQRGSGQVGTYGLNTFTNMEAQLVRQMEGEGVLSKADLENPHLLEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLKETACLGKAYAQMWSLMYFHRRDLRLASNAICSAVPVHWIPTSRTTWSIHAHHQWMTTEDMLTVWNRVWIEDNPWMEDKTPVTTWEDIPYLGKREDQWCGSLIGLTSRATWAQNILTAIQQVRSLIGDEEFLDYMPSMKRFRKEEESEGAIW

SEQ ID NO: 5062 - protein, 3290 aa, Artificial Sequence
  derived and/or modified protein sequence (wt) from DENV-3__FJ898456__SS-prME
TSLCLMMMLPATLAFHLTSRDGEPRMIVGKNERGKSLLFKTASGINMCTLIAMDLGEMCDDTVTYKCPLITEVEPEDIDCWCNLTSTWVTYGTCNQAGEHRRDKRSVALAPHVGMGLDTRTQTWMSAEGAWRQVEKVETWAFRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNVTTDSRCPTQGEAILPEEQDQNYVCKHTYVDRGWGNGCGLFGKGSLVTCAKFQCLESIEGKAVQHENLKYTVIITVHTGDQHQVGNETQGVTAEITPQASTVEAILPEYGTLGLECSPRTGLDFNEMILLTMKNKAWMVHRQWFFDLPLPWTSGATTETPTWNKKELLVTFKNAHAKKQEVVVLGSQEGAMHTALTGATEIQTSGGTSIFAGHLKCRLKMDKLELKGMSYAMCLNAFVLKKEVSETQHGTILIKVEYKGEDAPCKIPFSTEDGQGKAHNGRLITANPIVTKKEEPVNIEAEPPFGESNIVIGIGDKALKINWYKKGSSIGKMFEATARGARRMAILGDTAWDFGSVGGVLNSLGKMVHQIFGSAYTALFSGVSWIMKIGIGVLLTWIGLNSKNTSMSFSCIVIGIITLYLGAVVQADMGCVINWKGKELKCGSGIFVTNEVHTWTEQYKFQADSPKRLATAIAGAWENGVCGIRSTTRMENLLWKQIANELNYILWENNIKLTIVVGDVIGILEQGKRTLTPQPMELKYSWKTWGKAKIVTAETQNSSFIIDGPNTPECPSASRAWNVWEVEDYGFGVFTTNIWLKLREMYTQLCDHRLMSAAVKDERAVHADMGYWIESQKNGSWKLEKASLIEVKTCTWPKSHTLWSNGVLESDMIIPKSLAGPISQHNYRPGYHTQTAGPWHLGKLELDFNYCEGTTVVITENCGTRGPSLRTTTVSGKLIHEWCCRSCTLPPLRYMGEDGCWYGMEIRPINEKEENMVKSLVSAGSGKADNFTMGVLCLAIFFEEVMRGKFGKKHMIAGALFTFVLLLSGQITWRDMAHTLIMIGSNASDRMGMGVTYLALIATFKIQPFLALGFFLRKLTSRENLLLGVGLAMATTLQLPEDIEQMANGIALGLMALKLITQFETYQLWTALVSLMCSNTIFTLTVAWRTATLILAVISLLPVCQSSSMRKTDWLPMTVAAMGVPSLPLFIFSLKDTLKRRSWPLNEGVMAVGLVSILASSFLRNDVPMAGPLVAGGLLIACYVITGTSADLTVEKAADVTWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTHNGKRLEPNWANVKKDLISYGGGWKLSAQWQKGEEVQVIAVEPGKNPKSFQTMPGIFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIVMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFNTEYQKTKLNDWDFVVTTDISEMGANFKADRVIDPRRCLKPVILTDGPERVILAGPMPVTVASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGERNNQILEENMDVEIWTKEGEKKKLRPRWLDARTYSDPLALKEFKDFAAGRKSIALDLVTEIGRVPSHLAHRTRNALDNLVMLHTSEHGGRAYRHAVEELPETMETLLLLGLMILLTGGAMLFLISGKGIGKTSIGLICVVASSGMLWMADVPLQWIASAIVLEFFMMVLLIPEPEKQRTPQDNQLAYVVIGILTLAAIVAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLVTHYAIIGPGLQAKATREAQKRTAAGIMKNPTVDGIMTIDLDPVIYDSKFEKQLGQVMLLVLCAVQLLLMRTSWAFCEALTLATGPITTLWEGSPGKFWNTTIAVSMANIFRGSYLAGAGLAFSIMKSVGTGKRGTGSQGETLGEKWKKKLNQLSRKEFDLYKKSGITEVERTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVSSVNMVSRLLLNRFTMTHRRPTIEKDVDLGAGTRHVNAEPETPNMDVIGERIRRIKEEHSSTWHYDDENPYKTWAYHGSYEVKATGSASSMINGVVKLLTKPWDVVPMVTQMAMTDTTPFGQQRVFKEKVDTRTPRPMPGTRKVMEITAEWLWRTLGRNKRPRLCTREEFIKKVRTNAAMGAVFTEENQWDSARAAVEDEEFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRRLANAIFKLTYQNKVVKVQRPTPKGTVMDIISRKDQRGSGQVGTYGLNTFTNMEAQLIRQMEGEGVLSKADLENPHLLEKKVTQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLRETACLGKAYAQMWALMYFHRRDLRLASNAICSAVPVHWVPTSRTTWSIHAHHQWMTTEDMLTVWNRVWIEDNPWMEDKTPVTTWEDVPYLGKREDQWCGSLIGLASRATWAQNILTAIQQVRSLIGNEEFLDYMPSMKRFRKEEESEGAIW

SEQ ID NO: 5063 - protein, 3290 aa, Artificial Sequence
  derived and/or modified protein sequence (wt) from DENV-3__JN697379__SS-prME
TSLCLMMMLPATLAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAILPEEQDQNYVCKHTYVDRGWGNGCGLFGKGSLVTCAKFQCLESIEGKVVQHENLKYTVIITVHTGDQHQVGNETQGVTAEITSQASTAEVILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQTSGGTSIFAGHLKCRLKMDKLKLKGMSYAMCLNTFVLKKEVSETQHGTILIKVEYKGEDAPCKIPFSTEDGQGKAHNGRLITANPVVTKKEEPVNIEAEPPFGESNIVIGIGDKALKINWYRKGSSIGKMFEATARGARRMAILGDTAWDFGSVGGVLNSLGKMVHQIFGSAYTALFSGVSWIMKIGIGVLLTWIGLNSKNTSMSFSCIAIGIITLYLGVVVQADMGCVINWKGKELKCGSGIFVTNEVHTWTEQYKFQADSPKRLATAIAGAWENGVCGIRSTTRMENLLWKQIANELNYILWENNIKLTVVVGDITGVLEQGKRTLTPQPMELKYSWKTWGKAKIVTAETQNSSFIIDGPSTPECPSASRAWNVWEVEDYGFGVFTTNIWLKLREVYTQLCDHRLMSAAVKDERAVHADMGYWIESQKNGSWKLEKASLIEVKTCTWPKSHTLWSNGVLESDMIIPKSLAGPISQHNHRPGYHTQTAGPWHLGKLELDFNYCEGTTVVISENCGTRGPSLRTTTVSGKLIHEWCCRSCTLPPLRYMGEDGCWYGMEIRPINEKEENMVKSLASAGSGKVDNFTMGVLCLAILFEEVMRGKFGKKHMIAGVLFTFVLLLSGQITWRDMAHTLIMIGSNVSDRMGMGVTYLALIATFKIQPFLALGFFLRKLTSRENLLLGVGLAMAATLRLPEDIEQMANGIALGLMALKLITQFETYQLWTALVSLTCSNTIFTLTVAWRTATLILAGISLLPVCQSSSMRKTDWLPMTVAAMGVPPLPLFIFSLKDTLKRRSWPLNEGVMAVGLVSILASSLLRNDVPMAGPLVAGGLLIACYVITGTSADLTVEKAADVTWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTHNGKRLEPNWASVKKDLISYGGGWRLSAQWQKGEEVQVIAVEPGKNPKNFQTMPGIFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFVGKTVWFVPSIKAGNDIANCLRKNGKKVIQLSRKTFDTEYQKTKLNDWDFVVTTDISEMGANFKADRVIDPRRCLKPVILTDGPERVILAGPMPVTVASAAQRRGRVGRNPQKENDQYIFMGQPLNNDEDHAHWTEAKMLLDNINTPEGIIPALFEPEREKSAAIDGEYRLKGESRKTFVELMRRGDLPVWLAHKVASEGIKYTDRKWCFDGERNNQILEENMDVEIWTKEGEKKKLRPRWLDARTYSDPLALKEFKDFAAGRKSIALDLVTEIGRVPSHLAHRTRNALDNLVMLHTSEHGGRAYRHAVEELPETMETLLLLGLMILLTGGAMLFLISGKGIGKTSIGLICVIASSGMLWMADVPLQWIASAIVLEFFMMVLLIPEPEKQRTPQDNQLAYVVIGILTLAAIVAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLAAAVLLLVTHYAIIGPGLQAKATREAQKRTAAGIMKNPTVDGIMTIDLDPVIYDSKFEKQLGQVMLLVLCAVQLLLMRTSWALCEVLTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVSSVNMVSRLLLNRFTMTHRRPTIEKDVDLGAGTRHVNAEPETPNMDVIGERIKRIKEEHSSTWHYDDENPYKTWAYHGSYEVKATGSASSMINGVVKLLTKPWDVVPMVTQMAMTDTTPFGQQRVFKEKVDTRTPRPMPGTRKVMEITAEWLWRTLGRNKRPRLCTREEFTKKVRTNAAMGAVFTEENQWDSARAAVEDEEFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPKGTVMDIISRKDQRGSGQVGTYGLNTFTNMEAQLIRQMEGEGVLSKADLENPHPLEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLRETACLGKAYAQMWTLMYFHRRDLRLASNAICSAVPVHWVPTSRTTWSIHAHHQWMTTEDMLTVWNRVWIEDNPWMEDKTPVTTWEDVPYLGKREDQWCGSLIGLTSRATWAQNILTAIQQVRSLIGNEEFLDYMPSMKRFRKEEESEGAIW

SEQ ID NO: 5064 - protein, 3290 aa, Artificial Sequence
  derived and/or modified protein sequence (wt) from DENV-3__JQ045687__SS-prME
TSLCLMMMLPATLAFHLTSRDGEPRMIVGKNERGKSLLFKTASGINMCTLIAMDLGEMCDDTVTYKCPLVAEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAILPEEQDQNYVCKHTYVDRGWGNGCGLFGKGSLVTCAKFQCLEPIEGKVVQYENLKYTVIITVHTGDQHQVGNDTQGVTVEITPQASTVEAVLPEYGTLGLECSPRTGLDFNEMILLTMKNKAWMVHRQWFFDLPLPWTSGATTETPTWNKKELLVTFKNAHAKKQEVVVLGSQEGAMHTALTGATEIQNSGGTSIFAGHLKCRLKMDKLELKGMSYAMCLNTFVLKKEVSETQHGTILIKVEYKGEDAPCKIPFSTEDGQGKAHNGRLITANPVVTKKEEPVNIEAEPPFGESNIVIGIGDKALKINWYKKGSSIGKMFEATARGARRMAILGDTAWDFGSVGGVLNSLGKMVHQIFGSAYTALFSGVSWIMKIGIGVLLTWIGLNSKNTSMSFSCIVIGIITLYLGAVVQADMGCAINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSASRAWNVWEVEDYGFGVFTTNIWLKLREVYTQSCDHRLMSAAIKDERAVHADMGYWIESQKNGSWKLEKASFIEVKTCTWPKSHTLWSNGVLESDMIIPKSLAGPISQHNHRPGYHTQTAGPWHLGKLELDFNYCEGTTVVITENCGTRGPSLRTTTVSGKLIHEWCCRSCTLPPLRYMGEDGCWYGMEIRPINEKEENMVKSLVSAGSGKVDNFTMGVLCLAILFEEVMRGKFGKKHMIAGVLFTFVLLLSGQITWRDMAHTLIMIGSNASDRMGMGVTYLALIATFKIQPFLALGFFLRKLTSRENLLLGVGLAMATTLQLPEDIEQMANGIALGLMTLKLITQFETYQLWTALVSLTCSNTIFTLTVAWRTATLILAGVSLLPLCQSSSMRKTDWLPMTVAAMGVPPLPLFIFSLKDTPKRRSWPLNEGVMAVGLVSILASSLLRNDVPMAGPLVAGGLLIACYVITGTSADLTVEKAADVTWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTHNGKRLEPNWASVKKDLISYGGGWRLSAQWQKGEEVQVIAVEPGKNPKNFQTMPGIFQTTTGEIGAIALDFKPGTSGSPIINREGKVVGLYGNGVVTKNGGYVSGIAQTNAEPDGPTPELEEEMFKKRNLTTMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTAEAFPQSNAPIQDEERDIPERSWNSGNEWITDFVGKTVWFVPSIKAGNDIANCLRKNGKKVIQLSRKTFDTEYQKTRLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGERNNQILEENMDVEIWTKEGERKKLRPRWLDARTYSDPLALKEFKDFAAGRKSIALDLVTEIGRVPSHLAYRTRNALDNLVMLHTSEHGGRAYRHAVEELPETMETLLLLGLMILLTGGAMLFLISGKGIGKTSIGLICVIVSSGMLWMADVPLQWIASAIVLEFFMMVLLIPEPEKQRTPQDNQLAYVVIGILTLAAIVAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLVTHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGRRGTGSQGETLGEKWKKKLNQLSRKEFDLYKKSGITEVDRTEAKEGLKRGETTHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKYGGMLVRNPLSRNSTHEMYWISNGTGNIVSSVNMVSRLLLNRFTMTHRRPTIEKDVDLGAGTRHVNAEPETPNMDVIGERIKRIKEEHSSTWHYDDENPYKTWAYHGSYEVKATGSASSMINGVVKLLTKPWDVVPMVTQMAMTDTTPFGQQRVFKEKVDTRTPRPMPGTRKVMEITAEWLWRTLGRNKKPRLCTREEFTKKVRTNAAMGAVFTEENQWDSARAAVEDEEFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPKGTVMDIISRKDQRGSGQVGTYGLNTFTNMEAQLVRQMEGEGVLSKADLENPHLLEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLKETACLGKAYAQMWSLMYFHRRDLRLASNAICSAVPVHWIPTSRTTWSIHAHHQWMTTEDMLTVWNRVWIEDNPWMEDKTPVTTWEDVPYLGKREDQWCGSLIGLTSRATWAQNILTAIQQVRSLIGDEEFLDYMPSMKRFRKEEESEGAIW

SEQ ID NO: 5065 - protein, 3290 aa, Artificial Sequence
  derived and/or modified protein sequence (wt) from DENV-3__JQ045689__SS-prME
TSLCLMMMLPATLAFHLTSRDGEPRMIVGKNERGKSLLFKTASGINMCTLIAMDLGEMCDDTVTYKCPLIAEVEPEDIDCWCNLTSTWVTYGTCNQAGEHRRDKRSVALAPHVGMGLDTRTQTWMSAEGAWRQFEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAILPEEQDQNYVCKHTYVDRGWGNGCGLFGKGSLVTCAKFQCLEPIEGKVVQYENLKYTVIITVHTGDQHQVGNDTQGVTVEITPQASTVEAVLPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCLNTFVLKKEVSETQHGTILIKVEYKGEDAPCKIPFSTEDGQGKAHNGRLITANPVVTKKEEPVNIEAEPPFGESNIVIGIGDKALKINWYKKGSSIGKMFEATARGARRMAILGDTAWDFGSVGGVLNSLGKMVHQIFGSAYTALFSGVSWIMKIGIGVLLTWIGLNSKNTSMSFSCIVIGIITLYLGAVVQADMGCAINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSASRAWNVWEVEDYGFGVFTTNIWLKLREVYTQSCDHRLMSAAIKDERAVHADMGYWIESQKNGSWKLEKASFIEVKTCTWPKSHTLWSNGVLESDMIIPKSLAGPISQHNHRPGYHTQTAGPWHLGKLELDFNYCEGTTVVITENCGTRGPSLRTTTVSGKLIHEWCCRSCTLPPLRYMGEDGCWYGMEIRPINEKEENMVKSLVSAGSGKVDNFTMGVLCLAILFEEVMRGKFGKKHMIAGVLFTFVLLLSGQITWRDMAHTLIMIGSNASDRMGMGVTYLALIATFKIQPFLALGFFLRKLTSRENLLLGVGLAMATTLQLPEDIEQMANGIALGLMTLKLITQFETYQLWTALVSLTCSNTIFTLTVAWRTATLILAGVSLLPLCQSSSMRKTDWLPMTVAAMGVPPLPLFIFSLKDTPKRRSWPLNEGVMAVGLVSILASSLLRNDVPMAGPLVAGGLLIACYVITGTSADLTVEKAADVTWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTHNGKRLEPNWASVKKDLISYGGGWRLSAQWQKGEEVQVIAVEPGKNPKNFQTMPGIFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTAEAFPQSNAPIQDEERDIPERSWNSGNEWITDFVGKTVWFVPSIKAGNDIANCLRKNGKKVIQLSRKTFDTEYQKTRLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGERNNQILEENMDVEIWTKEGERKKLRPRWLDARTYSDPLALKEFKDFAAGRKSIALDLVTEIGRVPSHLAHRTRNALDNLVMLHTSEHGGRAYRHAVEELPETMETLLLLGLMILLTGGAMLFLISGKGIGKTSIGLICVIVSSGMLWMADVPLQWIASAIVLEFFMMVLLIPEPEKQRTPQDNQLAYVVIGILTLAAIVAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLVTHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGRRGTGSQGETLGEKWKKKLNQLSRKEFDLYKKSGITEVDRTEAKEGLKRGETTHHAVSRGSAKLQWFVERNMVTPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKYGGMLVRNPLSRNSTHEMYWISNGTGNIVSSVNMVSRLLLNRFTMTHRRPTIEKDVDLGAGTRHVNAEPETPNMDVIGERIKRIKEEHSSTWHYDDENPYKTWAYHGSYEVKATGSASSMINGVVKLLTKPWDVVPMVTQMAMTDTTPFGQQRVFKEKVDTRTPRPMPGTRKVMEITAEWLWRTLGRNKKPRLCTREEFTKKVRTNAAMGAVFTEENQWDSARAAVEDEEFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPKGTVMDIISRKDQRGSGQVGTYGLNTFTNMEAQLVRQMEGEGVLSKADLENPHLLEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLKETACLGKAYAQMWSLMYFHRRDLRLASNAICSAVPVHWIPTSRTTWSIHAHHQWMTTEDMLTVWNRVWIEDNPWMEDKTPVTTWEDIPYLGKREDQWCGSLIGLTSRATWAQNILTAIQQVRSLIGDEEFLDYMPSMKRFRKEEESEGAIW

SEQ ID NO: 5066 - protein, 3290 aa, Artificial Sequence
  derived and/or modified protein sequence (wt) from DENV-3__JQ045691__SS-prME
TSLCLMMMLPATLAFHLTSRDGEPRMIVGKNERGKSLLFKTASGINMCTLIAMDLGEMCDDTVTYKCPLIAEVEPEDIDCWCNLTSTWVTYGTCNQAGEHRRDKRSVALAPHIGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAILPEEQDQNYVCKHTYVDRGWGNGCGLFGKGSLVTCAKFQCLEPIEGKVVQYENLKYTVIITVHTGDQHQVGNDTQGVTVEITPQASTVEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQISGGTSIFAGHLKCRLKMDKLELKGMSYAMCLNTFVLKKEVSETQHGTILIKVEYKGEDAPCKIPFSTEDGQGKAHNGRLITANPVVTKKEEPVNIEAEPPFGESNIVIGIGDKALKINWYKKGSSIGKMFEATARGARRMAILGDTAWDFGSVGGVLNSLGKMVHQIFGSAYTALFSGVSWIMKIGIGVLLTWIGLNSKNTSMSFSCIVIGIITLYLGAVVQADMGCAINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSASRAWNVWEVEDYGFGVFTTNIWLKLREVYTQSCDHRLMSAAIKDERAVHADMGYWIESQKNGSWKLEKASFIEVKTCTWPKSHTLWSNGVLESDMIIPKSLAGPISQHNHRPGYHTQTAGPWHLGKLELDFNYCEGTTVVITENCGTRGPSLRTTTVSGKLIHEWCCRSCTLPPLRYMGEDGCWYGMEIRPINEKEENMVKSLVSAGSGKVDNFTMGVLCLAILFEEVMRGKFGKKHMIAGVLFTFVLLLSGQITWRDMAHTLIMIGSNASDRMGMGVTYLALIATFKIQPFLALGFFLRKLTSRENLLLGVGLAMATTLQLPEDIEQMANGIALGLMTLKLITQFETYQLWTALVSLTCSNTIFTLTVAWRTATLILAGVSLLPLCQSSSMRKTDWLPMTVAAMGVPPLPLFIFSLKDTPKKRSWPLNEGVMAVGLVSILASSLLRNDVPMAGPLVAGGLLIACYVITGTSADLTVEKAADVTWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTHNGKRLEPNWASVKKDLISYGGGWRLSAQWQKGEEVQVIAVEPGKNPKNFQTMPGIFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTAEAFPQSNAPIQDEERDIPERSWNSGNEWITDFVGKTVWFVPSIKAGNDIANCLRKNGKKVIQLSRKTFDTEYQKTRLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGERNNQILEENMDVEIWTKEGERKKLRPRWLDARTYSDPLALKEFKDFAAGRKSIALDLVTEIGRVPSHLAHRTRNALDNLVMLHTSEHGGRAYRHAVEELPETMETLLLLGLMILLTGGAMLFLLSGKGIGKTSIGLICVIVSSGMLWMADVPLQWIASAIVLEFFMMVLLIPEPEKQRTPQDNQLAYVVIGILTLAAIVAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLVTHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGRRGTGSQGETLGEKWKKKLNQLSRKEFDLYKKSGITEVDRTEAKEGLKRGETTHHAVSRGSAKLQWFVERNMVIPEGRVIDLGCGRGGWSYYCAGLKKVTEVRGYTKGGPGHEEPVPMSTYGWNLVKLMSGKDVFYLPPEKCDTLLCDIGESSPSSTVEESRTIRVLKMVEPWLKNNQFCIKVLNPYMPTVIEHLERLQRKYGGMLVRNPLSRNSTHEMYWISNGTGNIVSSVNMVSRLLLNRFTMTHRRPTIEKDVDLGAGTRHVNAEPETPNMDVIGERIKRIKEEHSSTWHYDDENPYKTWAYHGSYEVKATGSASSMINGVVKLLTKPWDVVPMVTQMAMTDTTPFGQQRVFKEKVDTRTPRAMPGTRKVMEITAEWLWRTLGRNKKPRLCTREEFTKKVRTNAAMGAVFTEENQWDSARAAVEDEEFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPKGTVMDIISRKDQRGSGQVGTYGLNTFTNMEAQLVRQMEGEGVLSKADLENSHLLEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLKETACLGKAYAQMWSLMYFHRRDLRLASNAICSAVPVHWIPTSRTTWSIHAHHQWMTTEDMLTVWNRVWIEDNPWMEDKTPVTTWEDVPYLGKREDQWCGSLIGLTSRATWAQNILTAIQQVRSLIGDEEFLDYMPSMKRFRKEEESEGAIW

SEQ ID NO: 5067 - protein, 3290 aa, Artificial Sequence
  derived and/or modified protein sequence (wt) from DENV-3__JQ045692__SS-prME
TSLCLMMMLPATLAFHLTSRDGEPRMIVGKNERGKSLLFKTASGINMCTLIAMDLGEMCDDTVTYKCPLIAEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAILPEEQDQNYVCKHTYVDRGWGNGCGLFGKGSLVTCAKFQCLEPIEGKVVQYENLKYTVIITVHTGDQHQVGNDTQGVTVEITPQASTVEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQISGGTSIFAGHLKCRLKMDKLELKGMSYAMCLNTFVLKKEVSETQHGTILIKVEYKGEDAPCKIPFSTEDGQGKAHNGRLITANPVVTKKEEPVNIEAEPPFGESNIVIGIGDKALKINWYKKGSSIGKMFEATARGARRMAILGDTAWDFGSVGGVLNSLGKMVHQIFGSAYTALFSGVSWIMKIGIGVLLTWIGLNSKNTSMSFSCIVIGIITLYLGAVVQADMGCAINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSASRAWNVWEVEDYGFGVFTTNIWLKLREVYTQSCDHRLMSAAIKDERAVHADMGYWIESQKNGSWKLEKASFIEVKTCTWPKSHTLWSNGVLESDMIIPKSLAGPISQHNHRPGYHTQTAGPWHLGKLELDFNYCEGTTVVITENCGTRGPSLRTTTVSGKLIHEWCCRSCTLPPLRYMGEDGCWYGMEIRPINEKEENMVKSLVSAGSGKVDNFTMGVLCLAILFEEVMRGKFGKKHMIAGVLFTFVLLLSGQITWRDMAHTLIMIGSNASDRMGMGVTYLALIATFKIQPFLALGFFLRKLTSRENLLLGVGLAMATTLQLPEDIEQMANGIALGLMTLKLITQFETYQLWTALVSLTCSNTIFTLTVAWRTATLILAGVSLLPLCQSSSMRKTDWLPMTVAAMGVPPLPLFIFSLKDTPKRRSWPLNEGVMAVGLVSILASSLLRNDVPMAGPLVAGGLLIACYVITGTSADLTVEKAADVTWEEEAEQTGVSHNLMITVDDDGTMRIKDDETENILTVLLKTALLIVSGIFPYSIPATLLVWHTWQKQTQRSGVLWDVPSPPEAQKAELEEGVYRIKQQGIFGKTQVGVGVQKEGVFHTMWHVTRGAVLTHNGKRLEPNWASVKKDLISYGGGWRLSAQWQKGEEVQVIAVEPGKNPKNFQTMPGIFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTAEAFPQSNAPIQDEERDIPERSWNSGNEWITDFVGKTVWFVPSIKAGNDIANCLRKNGKKVIQLSRKTFDTEYQKTRLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGERNNQILEENMDVEIWTKEGERKKLRPRWLDARTYSDPLALKEFKDFAAGRKSIALDLVTEIGRVPSHLAHRTRNALDNLVMLHTSEHGGRAYRHAVEELPETMETFLLLGLMILLTGGAMLFLLSGKGIGKTSIGLICVIVSSGMLWMADVPLQWIASAIVLEFFMMVLLIPEPEKQRTPQDNQLAYVVIGILTLAAIVAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLVTHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGRRGTGSQGETLGEKWKKKLNQLSRKEFDLYKKSGITEVDRTEAKEGLKRGETTHHAVSRGSAKLQWFVERNMVIPEGRVIDLGCGRGGWSYYCAGLKKVTEVRGYTKGGPGHEEPVPMSTYGWNLVKLMSGKDVFYLPPEKCDTLLCDIGESSPSSTVEESRTIRVLKMVEPWLKNNQFCIKVLNPYMPTVIEHLERLQRKYGGMLVRNPLSRNSTHEMYWISNGTGNIVSSVNMVSRLLLNRFTMTHRRPTIEKDVDLGAGTRHVNAEPETPNMDVIGERIKRIKEEHSSTWHYDDENPYKTWAYHGSYEVKATGSASSMINGVVKLLTKPWDVVPMVTQMAMTDTTPFGQQRVFKEKVDTRTPRAMPGTRKVMEITAEWLWRTLGRNKKPRLCTREEFTKKVRTNAAMGAVFTEENQWDSARAAVEDEEFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPKGTVMDIISRKDQRGSGQVGTYGLNTFTNMEAQLVRQMEGEGVLSKADLENPHLLEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLKETACLGKAYAQMWSLMYFHRRDLRLASNAICSAVPVHWIPTSRTTWSIHAHHQWMTTEDMLTVWNRVWIEDNPWMEDKTPVTTWEDVPYLGKREDQWCGSLIGLTSRATWAQNILTAIQQVRSLIGDEEFLDYMPSMKRFRKEEESEGAIW

SEQ ID NO: 5068 - protein, 3290 aa, Artificial Sequence
  derived and/or modified protein sequence (wt) from DENV-3__JQ045694__SS-prME
TSLCLMMMLPATLAFHLTSRDGEPRMIVGKNERGKSLLFKTASGINMCTLIAMDLGEMCDDTVTYKCPLIAEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAILPEEQDQNYVCKHTYVDRGWGNGCGLFGKGSLVTCAKFQCLEPIEGKVVQYENLKYTVIITVHTGDQHQVGNDTQGVTVEITPQASTVEAVLPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCLNTFVLKKEVSETQHGTILIKVEYKGEDAPCKIPFSTEDGQGKAHNGRLITANPVVTKKEEPVNIEAEPPFGESNIVIGIGDKALKINWYKKGSSIGKMFEATARGARRMAILGDTAWDFGSVGGVLNSLGKMVHQIFGSAYTALFSGVSWIMKIGIGVLLTWIGLNSKNTSMSFSCIVIGIITLYLGAVVQADMGCAINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSASRAWNVWEVEDYGFGVFTTNIWLKLREVYTQSCDHRLMSAAIKDERAVHADMGYWIESQKNGSWKLEKASFIEVKTCTWPKSHTLWSNGVLESDMIIPKSLAGPISQHNHRPGYHTQTAGPWHLGKLELDFNYCEGTTVVITENCGTRGPSLRTTTVSGKLIHEWCCRSCTLPPLRYMGEDGCWYGMEIRPINEKEENMVKSLVSAGSGKVDNFTMGVLCLAILFEEVMRGKFGKKHMIAGVLFTFVLLLSGQITWRDMAHTLIMIGSNASDRMGMGVTYLALIATFKIQPFLALGFFLRKLTSRENLLLGVGLAMATTLQLPEDIEQMANGIALGLMTLKLITQFETYQLWTALVSLTCSNTIFTLTVAWRTATLILAGVSLLPLCQSSSMRKTDWLPMTVAAMGVPPLPLFIFSLKDTPKRRSWPLNEGVMAVGLVSILASSLLRNDVPMAGPLVAGGLLIACYVITGTSADLTVEKAADVTWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTHNGKRLEPNWASVKKDLISYGGGWRLSAQWQKGEEVQVIAVEPGKNPKNFQTMPGIFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPIRVPNYNLIIMDEAHFTDPASIAARGYISTRVGMGEAAAIFMTATPPGTAEAFPQSNAPIQDEERDIPERSWNSGNEWITDFVGKTVWFVPSIKAGNDIANCLRKNGKKVIQLSRKTFDTEYQKTRLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGERNNQILEENMDVEIWTKEGERKKLRPRWLDARTYSDPLALKEFKDFAAGRKSIALDLVTEIGRVPSHLAYRTRNALDNLVMLHTSEHGGRAYRHAVEELPETMETLLLLGLMILLTGGAMLFLMSGKGIGKTSIGLICVIVSSGMLWMADVPLQWIASAIVLEFFMMVLLIPEPEKQRTPQDNQLAYVVIGILTLAAIVAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLVTHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGRRGTGPQGETLGEKWKKKLNQLSRKEFDLYKKSGITEVDRTEAKEGLKRGETTHHAVSRGSAKLQWFVERNMVIPEGRVIDLGCGRGGWSYYCAGLKKVTEVRGYTKGGPGHEEPVPMSTYGWNLVKLMSGRDVFYLPPEKCDTLLCDIGESSPSPTVEESRTIRVLKMVEPWLKNNQFCIKVLNPYMPTVIEHLERLQRKYGGMLVRNPLSRNSTHEMYWISNGTGNIVSSVNMVSRLLLNRFTMTHRRPTIEKDVDLGAGTRHVNAEPETPNMDVIGERIKRIKEEHSSTWHYDDENPYKTWAYHGSYEVKATGSASSMINGVVKLLTKPWDVVPMVTQMAMTDTTPFGQQRVFKEKVDTRTPRPMPGTRKVMEITAEWLWRTLGRNKKPRLCTREEFTKKVRTNAAMGAVFTEENQWDSARAAVEDEEFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPKGTVMDIISRKDQRGSGQVGTYGLNTFTNMEAQLVRQMEGEGVLSKADLENPHLLEKKITQWLETEGVERLKRMAISGDDCVVKPIDDRFANALLALNDMGKVRKDIPQWQPSKGWHDWQQVPFCSHHFHELIMKDGRKLVVPCRPQDELIGRARISQGAGWSLKETACLGKAYAQMWSLMYFHRRDLRLASNAICSAVPVHWIPTSRTTWSIHAHHQWMTTEDMLTVWNRVWIEDNPWMEDKTPVTTWEDVPYLGKREDQWCGSLIGLTSRATWAQNILTAIQQVRSLIGDEEFLDYMPSMKRFRKEEESEGAIW

SEQ ID NO: 5069 - protein, 3290 aa, Artificial Sequence
  derived and/or modified protein sequence (wt) from DENV-3__GU363549__SS-prME
TSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAVLPEEQDQNYVCKHTYVDRGWGNGCGLFGKGSLVTCAKFQCLEPIEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDAPCKIPFSTEDEQGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDTIGVLEQGKRTLTPQPMELKYSWKTWGKAKIVTAETQNSSFIIDGPNTPECPSASRAWNVWEVEDYGFGVFTTNIWLKLREVYTQMCDHRLMSAAVKDERAVHADMGYWIESQKNGSWKLEKASLIEVKTCTWPKSHTLWSNGVLESDMIIPKSLAGPISQHNYRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGKVDNFTMGVLCLAILFEEVMRGKFGKKHMIAGVFLTFMLLLSGQITWRDMAHTLIMIGSNASDRMGMGVTYLALIATFKIQPFLALGFFLRKLTSRENLLLGVGLAMATTIQLPEDIEQMANGIALGLMALKLITQFETYQLWTALISLTCSNTIFTLTVAWRTATLILAGVSLLPVCQSSSMRKTDWLPMTVAAMGVPPLPLFIFSLKDTLKRRSWPLNEGVMAVGLVSILASSLLRNDVPMAGPLVAGGLLIACYVITGTSADLTVEKAADVTWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGILGKTQVGVGVQKEGVFHTMWHVTRGAVLTHNGKRLEPNWASVKKDLISYGGGWRLSAQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMRHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTVASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKDFAAGRKSIALDLVTEIGRVPSHLAHRTRNALDNLVMLHTSEHGGRAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLVTHYAIIGPGLQAKATREAQKRTAAGIMKNPTVDGIITIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGETTHHAVSRGSAKLQWFVERNMVIPEGRVIDLGCGRGGWSYYCAGLKKVTEVRGYTKGGPGHEEPVPMSTHGWNIVKLMSGKDVFYLPPEKCDTLLCDIGESSPSPTVEESRTIRVLKMVEPWLKNNQFCIKVLNPYMPAVIEHLERLQRKHGGMLVRNPLSRNSTHEMYWISNGTGNIVSSVNMVSRLLLNRFTMTHRRPTIEKDVDLGAGTRHVNAEPETPNMDVIGERIRRIKEEHNSTWHYDDENPYKTWAYHGSYEVKATGSASSMINGVVKLLTKPWDVVPMVTQMAMTDTTPFGQQRVFKEKVDTRTPRPMPGTRKVMEITAEWLWRTLGRNKRPRLCTREEFTKKVRTNAAMGAVFTEENQWDSAKAAVEDEEFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMNPEHRLLANAIFKLTYQNKVVKVQRPTPTGTVMDIISRKDQRGSGQVGTYGLNTFTNMEAQLVRQMEGEGVLSKADLENPHLPEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLRETACLGKAYAQMWSLMYFHRRDLRLASNAICSAVPVHWVPTSRTTWSIHAHHQWMTTEDMLTVWNRVWIEDNPWMEDKTPVTTWENVPYLGKREDQWCGSLIGLTSRATWAQNISTAIQQVRSLIGNEEFLDYMPSMKRFRKEEESEGAIW

SEQ ID NO: 5070 - protein, 3290 aa, Artificial Sequence
  derived and/or modified protein sequence (wt) from DENV-3__KJ622197__SS-prME
TSLCLMMMLPATLAFHLTSRDGEPRMIVGKNERGKSLLFKTASGINMCTLIAMDLGEMCDDTVTYKCPLIAEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMAMRCVGVGNRDFVEGLSGATWVDVVLEHGGCVTTMAKNKPTLDIELQKTEATQLATLRKLCIEGKITNITTDSRCPTQGEAILPEEQDQNYVCKHTYVDRGWGNGCGLFGKGSLVTCAKFQCLESIEGKVVQHENLKYTVTITVHTGDQHQVGNDTQGVTAEITPQASTVEAILPEYGTLGLECSPRTGLDFNEMILLTMKNKAWMVHRQWFFDLPLPWTSGAITETPTWNRKELLVTFKNAHAKKQEVVVLGSQEGAMHTALTGATEIQNSGGTSIFAGHLKCRLKMDKLELKGMSYAMCLNTFVLKKEVSETQHGTILIKVEYKGEDAPCKIPFSTEDGQGKAHNGRLITANPVVTKKEEPVNIEAEPPFGESNIVIGIGDKALKINWYKKGSSIGKMFEATARGARRMAILGDTAWDFGSVGGVLNSLGKMVHQIFGSAYTALFGGVSWIMKIGIGVLLTWIGLNSKNTSMSFSCIVIGIITLYLGTVVQADMGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAEIQNSSFIIDGPNTPECPSASRAWNVWEVEDYGFGVFTTNIWLKLREVYTQTCDHRLMSAAIKDERAVHADMGYWIESQKNGSWKLEKASFIEVKTCTWPKSHTLWSNGVLESDMIIPKSLAGPISQHNHRPGYHTQTAGPWHLGKLELDFNYCEGTTVVITENCGTRGPSLRTTTVSGKLIHEWCCRSCTLPPLRYMGEDGCWYGMEIRPINEKEENMVKSLVSAGSGKVDNFTMGVLCLAILFEEVMRGKFGKKHMIAGVLLTFMLLLSGQITWRDMAHTLIMIGSNASDRMGMGVTYLALIATFKIQPFLALGFFLRKLTSRENLLLGVGLAMATTLQLPEDIEQMANGIALGLMALKLITQFETYQLWTALVSLTCSNTIFTLTVAWRTATLILAGVSLLPVCQSSSMRKTDWLPVAVAAMGVPPLPLFIFSLKDTLKRRSWPLNEGVMAVGLVSILASSLLRNDVPMAGPLVAGGLLIACYVITGTSADLTVEKAADVTWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTHNGKRLEPNWASVKKDLISYGGGWRLSAQWQKGEEVQVIAVEPGRNPKNFQTMPGIFQTTTGEIGAIALDFKPGTSGSPIINREGKVVGLYGNGVVTKNGGYVSGIAQANAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTAEAFPQSNAPIQDEERDIPERSWNSGNEWITDFVGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGERNNQILEENMDVEIWTKEGERKKLRPRWLDARTYSNPLALKEFKDFAAGRKSIALDLVTEIGRVPSHLAHRTRNALDNLVMLHTSEHGGRAYRHAVEELPETMETLLLLGLMILLTGGAMLFLISGKGIGKTSIGLICVIVSSGMLWMADVPLQWIASAIVLEFFMMVLLIPEPEKQRTPQDNQLAYVVIGILTLAAIVAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLVTHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRREFELYKKSGITEVDRTEAKEGLKRGETTHHAVSRGSAKLQWFVERNMVIPEGRVIDLGCGRGGWSYYCAGLKKVTEVRGYTKGGPGHEEPVPMSTYGWNTVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVSSVNMVSRLLLNRFTMTHRRPTIEKDVDLGAGTRHVNAEPETPNMDVIGERIKRIKEEHSSTWHYDDENPYKTWAYHGSYEVKATGSASSMINGVVKLLTKPWDVVPMVTQMAMTDTTPFGQQRVFKEKVDTRTPRPMPGTRKVMEITAEWLWRTLGRNKRPRLCTREEFTKKVRTNAAMGAVFTEENQWESARAAVEDEEFWKLVGRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPKGTVMDIISRKDQRGSGQVGTYGLNTFTNMEAQLIRQMEGEGVLSKADLENPHLLEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLKETACLGKAYAQMWSLMYFHRRDLRLASNAICSAVPVHWVPTSRTTWSIHAHHQWMTTEDMLTVWNRVWIEDNPWMEDKTPVTTWEDVPYLGKREDQWCGSLIGLTSRATWAQNILTAIQQVRSLIGDEEFLDYMPSMKRFRKEEESEGAIW

SEQ ID NO: 5071 - protein, 3290 aa, Artificial Sequence
  derived and/or modified protein sequence (wt) from DENV-3__KJ622198__SS-prME
TSLCLMMMLPATLAFHLTSRDGEPRMIVGKNERGKSLLFKTASGINMCTLIAMDLGEMCDDTVTYKCPLIAEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMAMRCVGVGNRDFVEGLSGATWVDVVLEHGGCVTTMAKNKPTLDIELQKTEATQLATLRKLCIEGKITNITTDSRCPTQGEAILPEEQDQNYVCKHTYVDRGWGNGCGLFGKGSLVTCAKFQCLESIEGKVVQHENLKYTVTITVHTGDQHQVGNDTQGVTAEITPQASTVEAILPEYGTLGLECSPRTGLDFNEMILLTMKNKAWMVHRQWFFDLPLPWTSGAITETPTWNRKELLVTFKNAHAKKQEVVVLGSQEGAMHTALTGATEIQNSGGTSIFAGHLKCRLKMDKLELKGMSYAMCLNTFVLKKEVSETQHGTILIKVEYKGEDAPCKIPFSTEDGQGKAHNGRLITANPVVTKKEEPVNIEAEPPFGESNIVIGIGDKALKINWYKKGSSIGKMFEATARGARRMAILGDTAWDFGSVGGVLNSLGKMVHQIFGSAYTALFGGVSWIMKIGIGVLLTWIGLNSKNTSMSFSCIVIGIITLYLGTVVQADMGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAEIQNSSFIIDGPNTPECPSASRAWNVWEVEDYGFGVFTTNIWLKLREVYTQTCDHRLMSAAIKDERAVHADMGYWIESQKNGSWKLEKASFIEVKTCTWPKSHTLWSNGVLESDMIIPKSLAGPISQHNHRPGYHTQTAGPWHLGKLELDFNYCEGTTVVITENCGTRGPSLRTTTVSGKLIHEWCCRSCTLPPLRYMGEDGCWYGMEIRPINEKEENMVKSLVSAGSGKVDNFTMGVLCLAILFEEVMRGKFGKKHMIAGVLLTFMLLLSGQITWRDMAHTLIMIGSNASDRMGMGVTYLALIATFKIQPFLALGFFLRKLTSRENLLLGVGLAMATTLQLPEDIEQMANGIALGLMALKLITQFETYQLWTALVSLTCSNTIFTLTVAWRTATLILAGVSLLPVCQSSSMRKTDWLPVAVAAMGVPPLPLFIFSLKDTLKRRSWPLNEGVMAVGLVSILASSLLRNDVPMAGPLVAGGLLIACYVITGTSADLTVEKAADVTWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTHNGKRLEPNWASVKKDLISYGGGWRLSAQWQKGEEVQVIAVEPGRNPKNFQTMPGIFQTTTGEIGAIALDFKPGTSGSPIINREGKVVGLYGNGVVTKNGGYVSGIAQANAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTAEAFPQSNAPIQDEERDIPERSWNSGNEWITDFVGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGERNNQILEENMDVEIWTKEGERKKLRPRWLDARTYSNPLALKEFKDFAAGRKSIALDLVTEIGRVPSHLAHRTRNALDNLVMLHTSEHGGRAYRHAVEELPETMETLLLLGLMILLTGGAMLFLISGKGIGKTSIGLICVIVSSGMLWMADVPLQWIASAIVLEFFMMVLLIPEPEKQRTPQDNQLAYVVIGILTLAAIVAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLVTHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRREFELYKKSGITEVDRTEAKEGLKRGETTHHAVSRGSAKLQWFVERNMVIPEGRVIDLGCGRGGWSYYCAGLKKVTEVRGYTKGGPGHEEPVPMSTYGWNTVKLMSGKDVFYLPPEKCDTLLCDIGESLPSPTVEESRTIRVLKMVEPWLKNNQFCIKVLNPYMPTVIEHLERLQRKHGGMLVRNPLSRNSTHEMYWISNGTGNIVSSVNMVSRLLLNRFTMTHRRPTIEKDVDLGAGTRHVNAEPETPNMDVIGERIKRIKEEHSSTWHYDDENPYKTWAYHGSYEVKATGSASSMINGVVKLLTKPWDVVPMVTQMAMTDTTPFGQQRVFKEKVDTRTPRPMPGTRKVMEITAEWLWRTLGRNKRPRLCTREEFTKKVRTNAAMGAVFTEENQWESARAAVEDEEFWKLVGRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPKGTVMDIISRKDQRGSGQVGTYGLNTFTNMEAQLIRQMEGEGVLSKADLENPHLLEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLKETACLGKAYAQMWSLMYFHRRDLRLASNAICSAVPVHWVPTSRTTWSIHAHHQWMTTEDMLTVWNRVWIEDNPWMEDKTPVTTWEDVPYLGKREDQWCGSLIGLTSRATWAQNILTAIQQVRSLIGDEEFLDYMPSMKRFRKEEESEGAIW

SEQ ID NO: 5072 - protein, 3290 aa, Artificial Sequence
  derived and/or modified protein sequence (wt) from DENV-3__KJ622191__SS-prME
TSLCLMMMLPATLAFHLTSRDGEPRMIVGKNERGKSLLFKTASGINMCTLIAMDLGEMCDDTVTYKCPLIAEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMAMRCVGVGNRDFVEGLSGATWVDVVLEHGGCVTTMAKNKPTLDIELQKTEATQLATLRKLCIEGKITNITTDSRCPTQGEAILPEEQDQNYVCKHTYVDRGWGNGCGLFGKGSLVTCAKFQCLESIEGKVVQHENLKYTVTITVHTGDQHQVGNDTQGVTAEITPQASTVEAILPEYGTLGLECSPRTGLDFNEVILLTMKNKAWMVHRQWFFDLPLPWTSGAITETPTWNRKELLVTFKNAHAKKQEVVVLGSQEGAMHTALTGATEIQNSGGTSIFAGHLKCRLKMDKLELKGMSYAMCLNTFVLKKEVSETQHGTILIKVEYKGEDAPCKIPFSTEDGQGKAHNGRLITANPVVTKKEEPVNIEAEPPFGESNIVIGIGDKALKINWYKKGSSIGKMFEATARGARRMAILGDTAWDFGSVGGVLNSLGKMVHQIFGSAYTALFGGVSWIMKIGIGVLLTWIGLNSKNTSMSFSCIVIGIITLYLGTVVQADMGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAEIQNSSFIIDGPNTPECPSASRAWNVWEVEDYGFGVFTTNIWLKLREVYTQTCDHRLMSAAIKDERAVHADMGYWIESQKNGSWKLEKASFIEVKTCTWPKSHTLWSNGVLESDMIIPKSLAGPISQHNHRPGYHTQTAGPWHLGKLELDFNYCEGTTVVITENCGTRGPSLRTTTVSGKLIHEWCCRSCTLPPLRYMGEDGCWYGMEIRPINEKEENMVKSLVSAGSGKVDNFTMGVLCLAILFEEVMRGKFGKKHMIAGVLLTFMLLLSGQITWRDMAHTLIMIGSNASDRMGMGVTYLALIATFKIQPFLALGFFLRKLTSRENLLLGVGLAMATTLQLPEDIEQMANGIALGLMALKLITQFETYQLWTALVSLTCSNTIFTLTVAWRTATLILAGVSLLPVCQSSSMRKTDWLPVAVAAMGVPPLPLFIFSLKDTLKRRSWPLNEGVMAVGLVSILASSLLRNDVPMAGPLVAGGLLIACYVITGTSADLTVEKAADVTWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTHNGKRLEPNWASVKKDLISYGGGWRLSAQWQKGEEVQVIAVEPGRNPKNFQTMPGIFQTTMGEIGAIALDFKPGTSGSPIINREGKVVGLYGNGVVTKNGGYVSGIAQANAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTAEAFPQSNAPIQDEERDIPERSWNSGNEWITDFVGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGERNNQILEENMDVEIWTKEGERKKLRPRWLDARTYSDPLALKEFKDFAAGRKSIALDLVTEIGRVPSHLAHRTRNALDNLVMLHTSEHGGRAYRHAVEELPETMETLLLLGLMILLTGGAMLFLISGKGIGKTSIGLICVIVSSGMLWMADVPLQWIASAIVLEFFMMVLLIPEPEKQRTPQDNQLAYVVIGILTLAAIVAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLVTHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRREFELYKKSGITEVDRTEAKEGLKRGETTHHAVSRGSAKLQWFVERNMVIPEGRVIDLGCGRGGWSYYCAGLKKVTEVRGYTKGGPGHEEPVPMSTYGWNTVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVSSVNMVSRLLLNRFTMTHRRPTIEKDVDLGAGTRHVNAEPETPNMDVIGERIKRIKEEHSSTWHYDDENPYKTWAYHGSYEVKATGSASSMINGVVKLLTKPWDVVPMVTQMAMTDTTPFGQQRVFKEKVDTRTPRPMPGTRKVMEITAEWLWRTLGRNKRPRLCTREEFTKKVRTNAAMGAVFTEENQWESARAAVEDEEFWKLVGRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPKGTVMDIISRKDQRGSGQVGTYGLNTFTNMEAQLIRQMEGEGVLSKADLENPHLLEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLKETACLGKAYAQMWSLMYFHRRDLRLASNAICSAVPVHWVPTSRTTWSIHAHHQWMTTEDMLTVWNRVWIEDNPWMEDKTPVTTWEDVPYLGKREDQWCGSLIGLTSRATWAQNILTAIQQVRSLIGDEEFLDYMPSMKRFRKEEESEGAIW

SEQ ID NO: 5073 - protein, 3290 aa, Artificial Sequence
  derived and/or modified protein sequence (wt) from DENV-3__KJ622192__SS-prME
TSLCLMMMLPATLAFHLTSRDGEPRMIVGKNERGKSLLFKTASGINMCTLIAMDLGEMCDDTVTYKCPLIAEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMAMRCVGVGNRDFVEGLSGATWVDVVLEHGGCVTTMAKNKPTLDIELQKTEATQLATLRKLCIEGKITNITTDSRCPTQGEAILPEEQDQNYVCKHTYVDRGWGNGCGLFGKGSLVTCAKFQCLESIEGKVVQHENLKYTVTITVHTGDQHQVGNDTQGVTAEITPQASTVEAILPEYGTLGLECSPRTGLDFNEMILLTMKNKAWMVHRQWFFDLPLPWTSGAITETPTWNRKELLVTFKNAHAKKQEVVVLGSQEGAMHTALTGATEIQNSGGTSIFAGHLKCRLKMDKLELKGMSYAMCLNTFVLKKEVSETQHGTILIKVEYKGEDAPCKIPFSTEDGQGKAHNGRLITANPVVTKKEEPVNIEAEPPFGESNIVIGIGDKALKINWYKKGSSIGKMFEATARGARRMAILGDTAWDFGSVGGVLNSLGKMVHQIFGSAYTALFGGVSWIMKIGIGVLLTWIGLNSKNTSMSFSCIVIGIITLYLGTVVQADMGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAEIQNSSFIIDGPNTPECPSASRAWNVWEVEDYGFGVFTTNIWLKLREVYTQTCDHRLMSAAIKDERAVHADMGYWIESQKNGSWKLEKASFIEVKTCTWPKSHTLWSNGVLESDMIIPKSLAGPISQHNHRPGYHTQTAGPWHLGKLELDFNYCEGTTVVITENCGTRGPSLRTTTVSGKLIHEWCCRSCTLPPLRYMGEDGCWYGMEIRPINEKEENMVKSLVSAGSGKVDNFTMGVLCLAILFEEVMRGKFGKKHMIAGVLLTFMLLLSGQITWRDMAHTLIMIGSNASDRMGMGVTYLALIATFKIQPFLALGFFLRKLTSRENLLLGVGLAMATTLQLPEDIEQMANGIALGLMALKLITQFETYQLWTALVSLTCSNTIFTLTVAWRTATLILAGVSLLPVCQSSSMRKTDWLPVAVAAMGVPPLPLFIFSLKDTLKRRSWPLNEGVMAVGLVSILASSLLRNDVPMAGPLVAGGLLIACYVITGTSADLTVEKAADVTWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTHNGKRLEPNWASVKKDLISYGGGWRLSAQWQKGEEVQVIAVEPGRNPKNFQTMPGIFQTTTGEIGAIALDFKPGTSGSPIINREGKVVGLYGNGVVTKNGGYVSGIAQANAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTAEAFPQSNAPIQDEERDIPERSWNSGNEWITDFVGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGERNNQILEENMDVEIWTKEGERKKLRPRWLDARTYSDPLALKEFKDFAAGRKSIALDLVTEIGRVPSHLAHRTRNALDNLVMLHTSEHGGRAYRHAVEELPETMETLLLLGLMILLTGGAMLFLISGKGIGKTSIGLICVIVSSGMLWMADVPLQWIASAIVLEFFMMVLLIPEPEKQRTPQDNQLAYVVIGILTLAAIVAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLVTHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRREFELYKKSGITEVDRTEAKEGLKRGETTHHAVSRGSAKLQWFVERNMVIPEGRVIDLGCGRGGWSYYCAGLKKVTEVRGYTKGGPGHEEPVPMSTYGWNTVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVSSVNMVSRLLLNRFTMTHRRPTIEKDVDLGAGTRHVNAEPETPNMDVIGERIKRIKEEHSSTWHYDDENPYKTWAYHGSYEVKATGSASSMINGVVKLLTKPWDVVPMVTQMAMTDTTPFGQQRVFKEKVDTRTPRPMPGTRKVMEITAEWLWRTLGRNKRPRLCTREEFTKKVRTNAAMGAVFTEENQWESARAAVEDEEFWKLVGRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPKGTVMDIISRKDQRGSGQVGTYGLNTFTNMEAQLIRQMEGEGVLSKADLENPHLLEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLKETACLGKAYAQMWSLMYFHRRDLRLASNAICSAVPVHWVPTSRTTWSIHAHHQWMTTEDMLTVWNRVWIEDNPWMEDKTPVTTWEDVPYLGKREDQWCGSLIGLTSRATWAQNILTAIQQVRSLIGDEEFLDYMPSMKRFRKEEESEGAIW

SEQ ID NO: 5074 - protein, 3290 aa, Artificial Sequence
  derived and/or modified protein sequence (wt) from DENV-3__KJ622193__SS-prME
TSLCLMMMLPATLAFHLTSRDGEPRMIVGKNERGKSLLFKTASGINMCTLIAMDLGEMCDDTVTYKCPLIAEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMAMRCVGVGNRDFVEGLSGATWVDVVLEHGGCVTTMAKNKPTLDIELQKTEATQLATLRKLCIEGKITNITTDSRCPTQGEAILPEEQDQNYVCKHTYVDRGWGNGCGLFGKGSLVTCAKFQCLESIEGKVVQHENLKYTVTITVHTGDQHQVGNDTQGVTAEITPQASTVEAILPEYGTLGLECSPRTGLDFNEMILLTMKNKAWMVHRQWFFDLPLPWTSGAITETPTWNRKELLVTFKNAHAKKQGVVVLGSQEGAMHTALTGATEIQNSGGTSIFAGHLKCRLKMDKLELKGMSYAMCLNTFVLKKEVSETQHGTILIKVEYKGEDAPCKIPFSTEDGQGKAHNGRLITANPVVTKKEEPVNIEAEPPFGESNIVIGIGDKALKINWYKKGSSIGKMFEATARGARRMAILGDTAWDFGSVGGVLNSLGKMVHQIFGSAYTALFGGVSWIMKIGIGVLLTWIGLNSKNTSMSFSCIVIGIITLYLGTVVQADMGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAEIQNSSFIIDGPNTPECPSASRAWNVWEVEDYGFGVFTTNIWLKLREVYTQTCDHRLMSAAIKDERAVHADMGYWIESQKNGSWKLEKASFIEVKTCTWPKSHTLWSNGVLESDMIIPKSLAGPISQHNHRPGYHTQTAGPWHLGKLELDFNYCEGTTVVITENCGTRGPSLRTTTVSGKLIHEWCCRSCTLPPLRYMGEDGCWYGMEIRPINEKEENMVKSLVSAGSGKVDNFTMGVLCLAILFEEVMRGKFGKKHMIAGVLLTFMLLLSGQITWRDMAHTLIMIGSNASDRMGMGVTYLALIATFKIQPFLALGFFLRKLTSRENLLLGVGLAMATTLQLPEDIEQMANGIALGLMALKLITQFETYQLWTALVSLTCSNTIFTLTVAWRTATLILAGVSLLPVCQSSSMRKTDWLPVAVAAMGVPPLPLFIFSLKDTLKRRSWPLNEGVMAVGLVSILASSLLRNDVPMAGPLVAGGLLIACYVITGTSADLTVEKAADVTWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTHNGKRLEPNWASVKKDLISYGGGWRLSAQWQKGEEVQVIAVEPGRNPKNFQTMPGIFQTTTGEIGAIALDFKPGTSGSPIINREGKVVGLYGNGVVTKNGGYVSGIAQANAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTAEAFPQSNAPIQDEERDIPERSWNSGNEWITDFVGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGERNNQILEENMDVEIWTKEGERKKLRPRWLDARTYSDPLALKEFKDFAAGRKSIALDLVTEIGRVPSHLAHRTRNALDNLVMLHTSEHGGRAYRHAVEELPETMETLLLLGLMILLTGGAMLFLISGKGIGKTSIGLICVIVSSGMLWMADVPLQWIASAIVLEFFMMVLLIPEPEKQRTPQDNQLAYVVIGILTLAAIVAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLVTHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRREFELYKKSGITEVDRTEAKEGLKRGETTHHAVSRGSAKLQWFVERNMVIPEGRVIDLGCGRGGWSYYCAGLKKVTEVRGYTKGGPGHEEPVPMSTYGWNTVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVSSVNMVSRLLLNRFTMTHRRPTIEKDVDLGAGTRHVNAEPETPNMDVIGERIKRIKEEHSSTWHYDDENPYKTWAYHGSYEVKATGSASSMINGVVKLLTKPWDVVPMVTQMAMTDTTPFGQQRVFKEKVDTRTPRPMPGTRKVMEITAEWLWRTLGRNKRPRLCTREEFTKKVRTNAAMGAVFTEENQWESARAAVEDEEFWKLVGRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPKGTVMDIISRKDQRGSGQVGTYGLNTFTNMEAQLIRQMEGEGVLSKADLENPHLLEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLKETACLGKAYAQMWSLMYFHRRDLRLASNAICSAVPVHWVPTSRTTWSIHAHHQWMTTEDMLTVWNRVWIEDNPWMEDKTPVTTWEDVPYLGKREDQWCGSLIGLTSRATWAQNILTAIQQVRSLIGDEEFLDYMPSMKRFRKEEESEGAIW

SEQ ID NO: 5075 - protein, 3290 aa, Artificial Sequence
  derived and/or modified protein sequence (wt) from DENV-3__KJ622194__SS-prME
TSLCLMMMLPATLAFHLTSRDGEPRMIVGKNERGKSLLFKTASGINMCTLIAMDLGEMCDDTVTYKCPLIAEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMAMRCVGVGNRDFVEGLSGATWVDVVLEHGGCVTTMAKNKPTLDIELQKTEATQLATLRKLCIEGKITNITTDSRCPTQGEAILPEEQDQNYVCKHTYVDRGWGNGCGLFGKGSLVTCAKFQCLESIEGKVVQHENLKYTVTITVHTGDQHQVGNDTQGVTAEITPQASTVEAILPEYGTLGLECSPRTGLDFNEMILLTMKNKAWMVHRQWFFDLPLPWTSGAITETPTWNRKELLVTFKNAHAKKQEVVVLGSQEGAMHTALTGATEIQNSGGTSIFAGHLKCRLKMDKLELKGMSYAMCLNTFVLKKEVSETQHGTILIKVEYKGEDAPCKIPFSTEDGQGKAHNGRLITANPVVTKKEEPVNIEAEPPFGESNIVIGIGDKALKINWYKKGSSIGKMFEATARGARRMAILGDTAWDFGSVGGVLNSLGKMVHQIFGSAYTALFGGVSWIMKIGIGVLLTWIGLNSKNTSMSFSCIVIGIITLYLGTVVQADMGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAEIQNSSFIIDGPNTPECPSASRAWNVWEVEDYGFGVFTTNIWLKLREVYTQTCDHRLMSAAIKDERAVHADMGYWIESQKNGSWKLEKASFIEVKTCTWPKSHTLWSNGVLESDMIIPKSLAGPISQHNHRPGYHTQTAGPWHLGKLELDFNYCEGTTVVITENCGTRGPSLRTTTVSGKLIHEWCCRSCTLPPLRYMGEDGCWYGMEIRPINEKEENMVKSLVSAGSGKVDNFTMGVLCLAILFEEVMRGKFGKKHMIAGVLLTFMLLLSGQITWRDMAHTLIMIGSNASDRMGMGVTYLALIATFKIQPFLALGFFLRKLTSRENLLLGVGLAMATTLQLPEDIEQMANGIALGLMALKLITQFETYQLWTALVSLTCSNTIFTLTVAWRTATLILAGVSLLPVCQSSSMRKTDWLPVAVAAMGVPPLPLFIFSLKDTLKRRSWPLNEGVMAVGLVSILASSLLRNDVPMAGPLVAGGLLIACYVITGTSADLTVEKAADVTWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTHSGKRLEPNWASVKKDLISYGGGWRLSAQWQKGEEVQVIAVEPGRNPKNFQTMPGIFQTTTGEIGAIALDFKPGTSGSPIINREGKVVGLYGNGVVTKNGGYVSGIAQANAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTAEAFPQSNAPIQDEERDIPERSWNSGNEWITDFVGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGERNNQILEENMDVEIWTKEGERKKLRPRWLDARTYSDPLALKEFKDFAAGRKSIALDLVTEIGRVPSHLAHRTRNALDNLVMLHTSEHGGRAYRHAVEELPETMETLLLLGLMILLTGGAMLFLISGKGIGKTSIGLICVIVSSGMLWMADVPLQWIASAIVLEFFMMVLLIPEPEKQRTPQDNQLAYVVIGILTLAAIVAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLVTHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNATIAVSMANIFRGSYLAGAGLAFSIMKSVGTGKRGTGSQGETLGEKWKKKLNQLSRREFELYKKSGITEVDRTEAKEGLKRGETTHHAVSRGSAKLQWFVERNMVIPEGRVIDLGCGRGGWSYYCAGLKKVTEVRGYTKGGPGHEEPVPMSTYGWNTVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVSSVNMVSRLLLNRFTMTHRRPTIEKDVDLGAGTRHVNAEPETPNMDVIGERIKRIKEEHSSTWHYDDENPYKTWAYHGSYEVKATGSASSMINGVVKLLTKPWDVVPMVTQMAMTDTTPFGQQRVFKEKVDTRTPRPMPGTRKVMEITAEWLWRTLGRNKRPRLCTREEFTKKVRTNAAMGAVFTEENQWESARAAVEDEEFWKLVGRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPKGTVMDIISRKDQRGSGQVGTYGLNTFTNMEAQLIRQMEGEGVLSKADLENPHLLEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLKETACLGKAYAQMWSLMYFHRRDLRLASNAICSAVPVHWVPTSRTTWSIHAHHQWMTTEDMLTVWNRVWIEDNPWMEDKTPVTTWEDVPYLGKREDQWCGSLIGLTSRATWAQNILTAIQQVRSLIGDEEFLDYMPSMKRFRKEEESEGAIW

SEQ ID NO: 5076 - protein, 3290 aa, Artificial Sequence
  derived and/or modified protein sequence (wt) from DENV-3__KJ622195__SS-prME
TSLCLMMMLPATLAFHLTSRDGEPRMIVGKNERGKSLLFKTASGINMCTLIAMDLGEMCDDTVTYKCPLIAEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMAMRCVGVGNRDFVEGLSGATWVDVVLEHGGCVTTMAKNKPTLDIELQKTEATQLATLRKLCIEGKITNITTDSRCPTQGEAILPEEQDQNYVCKHTYVDRGWGNGCGLFGKGSLVTCAKFQCLESIEGKVVQHENLKYTVTITVHTGDQHQVGNDTQGVTAEITPQASTVEAILPEYGTLGLECSPRTGLDFNEMILLTMKNKAWMVHRQWFFDLPLPWTSGAITETPTWNRKELLVTFKNAHAKKQEVVVLGSQEGAMHTALTGATEIQNSGGTSIFAGHLKCRLKMDKLELKGMSYAMCLNTFVLKKEVSETQHGTILIKVEYKGEDAPCKIPFSTEDGQGKAHNGRLITANPVVTKKEEPVNIEAEPPFGESNIVIGIGDKALKINWYKKGSSIGKMFEATARGARRMAILGDTAWDFGSVGGVLNSLGKMVHQIFGSAYTALFGGVSWIMKIGIGVLLTWIGLNSKNTSMSFSCIVIGIITLYLGTVVQADMGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAEIQNSSFIIDGPNTPECPSASRAWNVWEVEDYGFGVFTTNIWLKLREVYTQTCDHRLMSAAIKDERAVHADMGYWIESQKNGSWKLEKASFIEVKTCTWPKSHTLWSNGVLESDMIIPKSLAGPISQHNHRPGYHTQTAGPWHLGKLELDFNYCEGTTVVITENCGTRGPSLRTTTVSGKLIHEWCCRSCTLPPLRYMGEDGCWYGMEIRPINEKEENMVKSLVSAGSGKVDNFTMGVLCLAILFEEVMRGKFGKKHMIAGVLLTFMLLLSGQITWRDMAHTLIMIGSNASDRMGMGVTYLALIATFKIQPFLALGFFLRKLTSRENLLLGVGLAMATTLQLPEDIEQMANGIALGLMALKLITQFETYQLWTALVSLTCSNTIFTLTVAWRTATLILAGVSLLPVCQSSSMRKTDWLPVAVAAMGVPPLPLFIFSLKDTLKRRSWPLNEGVMAVGLVSILASSLLRNDVPMAGPLVAGGLLIACYVITGTSADLTVEKAADVTWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTHNGKRLEPNWASVKKDLISYGGGWRLSAQWQKGEEVQVIAVEPGRNPKNFQTMPGIFQTTTGEIGAIALDFKPGTSGSPIIDREGKVVGLYGNGVVTKNGGYVSGIAQANAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTAEAFPQSNAPIQDEERDIPERSWNSGNEWITDFVGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGERNNQILEENMDVEIWTKEGERKKLRPRWLDARTYSNPLALKEFKDFAAGRKSIALDLVTEIGRVPSHLAHRTRNALDNLVMLHTSEHGGRAYRHAVEELPETMETLLLLGLMILLTGGAMLFLISGKGIGKTSIGLICVIVSSGMLWMADVPLQWIASAIVLEFFMMVLLIPEPEKQRTPQDNQLAYVVIGILTLAAIVAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLVTHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRREFELYKKSGITEVDRTEAKEGLKRGETTHHAVSRGSAKLQWFVERNMVIPEGRVIDLGCGRGGWSYYCAGLKKVTEVRGYTKGGPGHEEPVPMSTYGWNTVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVSSVNMVSRLLLNRFTMTHRRPTIEKDVDLGAGTRHVNAEPETPNMDVIGERIKRIKEEHSSTWHYDDENPYKTWAYHGSYEVKATGSASSMINGVVKLLTKPWDVVPMVTQMAMTDTTPFGQQRVFKEKVDTRTPRPMPGTRKVMEITAEWLWRTLGRNKRPRLCTREEFTKKVRTNAAMGAVFTEENQWESARAAVEDEEFWKLVGRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPKGTVMDIISRKDQRGSGQVGTYGLNTFTNMEAQLIRQMEGEGVLSKADLENPHLLEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLKETACLGKAYAQMWSLMYFHRRDLRLASNAICSAVPVHWVPTSRTTWSIHAHHQWMTTEDMLTVWNRVWIEDNPWMEDKTPVTTWEDVPYLGKREDQWCGSLIGLTSRATWAQNILTAIQQVRSLIGDEEFLDYMPSMKRFRKEEESEGAIW

SEQ ID NO: 5077 - protein, 3290 aa, Artificial Sequence
  derived and/or modified protein sequence (wt) from DENV-3__KJ622196__SS-prME
TSLCLMMMLPATLAFHLTSRDGEPRMIVGKNERGKSLLFKTASGINMCTLIAMDLGEMCDDTVTYKCPLIAEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMAMRCVGVGNRDFVEGLSGATWVDVVLEHGGCVTTMAKNKPTLDIELQKTEATQLATLRKLCIEGKITNITTDSRCPTQGEAILPEEQDQNYVCKHTYVDRGWGNGCGLFGKGSLVTCAKFQCLESIEGKVVQHENLKYTVTITVHTGDQHQVGNDTQGVTAEITPQASTVEAILPEYGTLGLECSPRTGLDFNEMILLTMKNKAWMVHRQWFFDLPLPWTSGAITETPTWNRKELLVTFKNAHAKKQEVVVLGSQEGAMHTALTGATEIQNSGGTSIFAGHLKCRLKMDKLELKGMSYAMCLNTFVLKKEVSETQHGTILIKVEYKGEDAPCKIPFSTEDGQGKAHNGRLITANPVVTKKEEPVNIEAEPPFGESNIVIGIGDKALKINWYKKGSSIGKMFEATARGARRMAILGDTAWDFGSVGGVLNSLGKMVHQIFGSAYTALFGGVSWIMKIGIGVLLTWIGLNSKNTSMSFSCIVIGIITLYLGTVVQADMGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAEIQNSSFIIDGPNTPECPSASRAWNVWEVEDYGFGVFTTNIWLKLREVYTQTCDHRLMSAAIKDERAVHADMGYWIESQKNGSWKLEKASFIEVKTCTWPKSHTLWSNGVLESDMIIPKSLAGPISQHNHRPGYHTQTAGPWHLGKLELDFNYCEGTTVVITENCGTRGPSLRTTTVSGKLIHEWCCRSCTLPPLRYMGEDGCWYGMEIRPINEKEENMVKSLVSAGSGKVDNFTMGVLCLAILFEEVMRGKFGKKHMIAGVLLTFMLLLSGQITWRDMAHTLIMIGSNASDRMGMGVTYLALIATFKIQPFLALGFFLRKLTSRENLLLGVGLAMATTLQLPEDIEQMANGIALGLMALKLITQFETYQLWTALVSLTCSNTIFTLTVAWRTATLILAGVSLLPVCQSSSMRKTDWLPVAVAAMGVPPLPLFIFSLKDTLKRRSWPLNEGVMAVGLVSILASSLLRNDVPMAGPLVAGGLLIACYVITGTSADLTVEKAADVTWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTHNGKRLEPNWASVKKDLISYGGGWRLSAQWQKGEEVQVIAVEPGRNPKNFQTMPGIFQTTTGEIGAIALDFKPGTSGSPIINREGKVVGLYGNGVVTKNGGYVSGIAQANAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTAEAFPQSNAPIQDEERDIPERSWNSGNEWITDFVGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGERNNQILEENMDVEIWTKEGERKKLRPRWLDARTYSNPLALKEFKDFAAGRKSIALDLVTEIGRVPSHLAHRTRNALDNLVMLHTSEHGGRAYRHAVEELPETMETLLLLGLMILLTGGAMLFLISGKGIGKTSIGLICVIVSSGMLWMADVPLQWIASAIVLEFFMMVLLIPEPEKQRTPQDNQLAYVVIGILTLAAIVAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLVTHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRREFELYKKSGITEVDRTEAKEGLKRGETTHHAVSRGSAKLQWFVERNMVIPEGRVIDLGCGRGGWSYYCAGLKKVTEVRGYTKGGPGHEEPVPMSTYGWNTVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVSSVNMVSRLLLNRFTMTHRRPTIEKDVDLGAGTRHVNAEPETPNMDVIGERIKRIKEEHSSTWHYDDENPYKTWAYHGSYEVKATGSASSMINGVVKLLTKPWDVVPMVTHMAMTDTTPFGQQRVFKEKVDTRTPRPMPGTRKVMEITAEWLWRTLGRNKRPRLCTREEFTKKVRTNAAMGAVFTEENQWESARAAVEDEEFWKLVGRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPKGTVMDIISRKDQRGSGQVGTYGLNTFTNMEAQLIRQMEGEGVLSKADLENPHLLEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLKETACLGKAYAQMWSLMYFHRRDLRLASNAICSAVPVHWVPTSRTTWSIHAHHQWMTTEDMLTVWNRVWIEDNPWMEDKTPVTTWEDVPYLGKREDQWCGSLIGLTSRATWAQNILTAIQQVRSLIGDEEFLDYMPSMKRFRKEEESEGAIW

SEQ ID NO: 5078 - protein, 3290 aa, Artificial Sequence
  derived and/or modified protein sequence (wt) from DENV-3__KJ830751__SS-prME
TSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAVLPEEQDQNYVCKHTYVDRGWGNGCGLFGKGSLVTCAKFQCLEPIEGKVVQYENLKYTVIITVHTGDQHQVGNETQGVTAEITPQASTTEAILPEYGTLGLECSPRTGLDFNEMILLTMKNKAWMVHRQWFFDLPLPWASGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDAPCKIPFSTEDGQGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDTIGVLEQGKRTLTPQPMELKYSWKTWGKAKIVTAETQNSSFIIDGPNTPECPSASRAWNVWEVEDYGFGVFTTNIWLKLREVYTQLCDHRLMSAAVKDERAVHADMGYWIESQKNGSWKLEKASLIEVKTCTWPKSHTLWSNGVLESDMIIPKSLAGPISQHNYRPGYHTQTAGPWHLGKLELDFNYCEGTTVVITESCGTRGPSLRTTTVSGKLIHEWCCRSCTLPPLRYMGEDGCWYGMEIRPISEKEENMVKSLVSAGSGKVDNFTMGVLCLAILYEEVMRGKFGKKHMIAGVFFTFVLLLSGQITWRNMAHTLIMIGSNASDRMGMGVTYLALIATFKIQPFLALGFFLRKLTSRENLLLGVGLAMATTLQLPDDIEQMANGIALGLMALKLITQFETYQLWTALVSLTCSNTMFTLTVAWRTATLILAGVSLLPVCQSSSMRKTDWLPMAVAAMGVPPLPLFIFNLKDTLKRRSWPLNEGVMAVGLVSILASSLLRNDVPMAGPLVAGGLLIACYVITGTSADLTVEKAADVTWEEEAEQTGVSHNLMITVDDDGTMRIKDDEIENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTHNGKRLEPNWASVKKDLISYGGGWRLSAQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGILPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKDFAAGRKSIALDLVTEIGRVPSHLAHRTRNALDNLVMLHTSEHGGRAYRHAVEELPETMETLLLLGLMILLTGGAMLFLISGKGIGKTSIGLICVIASSGMLWMAEVPLQWIASAIVLEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGETTHHAVSRGSAKLQWFVERNMVVPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVSSVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRPMPGTRKVMEITAEWLWRTLGRNKRPRLCTREEFTKKVRTNAAMGAVFTEENQWDSAKAAVEDEEFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKIIQQMDPEHRQLANAIFKLTYQNKVVKVQRPTPTGTVMDIISRKDQRGSGQVGTYGLNTFTNMEAQLVRQMEGEGVLTKADLENSHLPEKKITQWLETKGVERLKRMAISGDDCVVKPIDDRFANALVALNDMGKVRKDIPQWQPSRGWHDWQQVPFCSHHFHELIMKDGRKLVVPCRPQDELIGRARISQGAGWSLRETACLGKAYAQMWSLMYFHRRDLRLASNAICSAVPVHWVPTSRTTWSIHAHHQWMTTEDMLTVWNRVWIEENPWMEDKTPVTTWENVPYLGKREDQWCGSLIGLTSRATWAQNIPTAIQQVRSLIGNEEFLDYMPSMKRFRKEEESEGAIW

SEQ ID NO: 5079 - protein, 3290 aa, Artificial Sequence
  derived and/or modified protein sequence (wt) from DENV-3__KC762681__SS-prME
TSLCLMMMLPATLAFHLTSRDGEPRMIVGKNERGKSLLFKTASGINMCTLIAMDLGEMCDDTVTYKCPLITEVEPEDIDCWCNLTSTWVTYGTCNQAGEHRRDKRSVALAPHVGMGLDTRTQTWMSAEGAWRQVEKVETWAFRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNVTTDSRCPTQGEAILPEEQDQNYVCKHTYVDRGWGNGCGLFGKGSLVTCAKFQCLEFIEGKVVQHENLKYTVIITVHTGDQHQVGNETQGVTAEITPQASTVEAILPEYGTLGLECSPRTGLDFNEMILLTMKNKAWMVHRQWFFDLPLPWTSGATTETPTWNKKELLVTFKNAHAKKQEVVVLGSQEGAMHTALTGATEIQTSGGTSIFAGHLKCRLKMDKLELKGMSYAMCLNAFVLKKEVSETQHGTILIKVEYKGEDAPCKIPFSTEDGQGKAHNGRLITANPVVTKKEEPVNIEAEPPFGESNIVIGIGDKALKINWYKKGSSIGKMFEATARGARRMAILGDTAWDFGSVGGVLNSLGKMVHQIFGSAYTALFSGVSWIMKIGIGVLLTWIGLNSKNTSMSFSCIVIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMDLKYSWKTWGKAKIVTAETQNSSFIIDGPNTPECPSASRAWNVWEVEDYGFGVFTTNIWLKLREMYTQLCDHRLMSAAVKDERAVHADMGYWIESQKNGSWKLEKASLIEVKTCTWPKSHTLWSNGVLESDMIIPKSLAGPVSQHNYRPGYHTQTAGPWHLGKLELDFNYCEGTTVVITENCGTRGPSLRTTTVSGKLIHEWCCRSCTLPPLRYMGEDGCWYGMEIRPINEKEENMVKSLVSAGSGKVDNFTMGVLCLAILFEEVMRGKFGKKHMIAGVLFTFVLLLSGQITWRDMARTLIMIGSNASDRMGMGVTYLALIATFKIQPFLALGFFLRKLTSRENLLLGVGLAMATTLQLPEDIEQMANGIALGLMALKLITQFETYQLWTALVSLMCSNTMFTLTVAWRTATLILAGISLLPVCQSSSMRKTDWLPVTVAAMGVPPLPLFIFSLKDTLKRRSWPLNEGVMAVGLVSILASSLLRNDVPMAGPLVAGGLLIACYVITGTSADLTVEKAADVIWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTHNGKRLEPNWASVKKDLISYGGGWRLSAQWQKGEEVQVIAVEPGKNPKNFQTMPGIFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSAHTGKEIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKTDRVIDPRRCLKPVILTDGPERVILAGPMPVTVASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGERNNQILEENMDVEIWTKEGEKKKLRPRWLDARTYSDPLALKEFKDFAAGRKSIALDLVTEIGRVPSHLAHRTRNALDNLVMLHTSEHGGRAYRHAVEELPETMETLLLLGLMILLTGGAMLFLISGKGIGKTSIGLICVVASSGMLWMADVPLQWIASAIVLEFFMMVLLIPEPEKQRTPQDNQLAYVVIGILTLAAIVAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLVTHYAIIGPGLQAKATREAQKRTAAGIMKNPTVDGIMTIDLDPVIYDSKFEKQLGQVMLLVLCAVQLLLMRTSWAFCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVSSVNMVSRLLLNRFTMTHRRPTIEKDVDLGAGTRHVNAEPETPNMDVIGERIRRIKEEHSSTWHYDEENPYKTWAYHGSYEVKATGSASSMINGVVKLLTKPWDVVPTVTQMAMTDTTPFGQQRVFKEKVDTRTPRPMPGTRKAMEITAEWLWRTLGRNKRPRLCTREEFTKKVRTNAAMGAVFTEENQWDSARAAVEDEEFWKLVDRERELHKLGKCGSCVYNMMGKREKKLGEFGKAKGSRAIWYMWLGARYLEFEALGFLNEDHWFSRENSFSGVEGEGLHKLGYILRDISKIPGGAMYADDTAGWDTRITEDDLHNEEKITQQMDPEHRQLANAIFKLTYQNKVVKVQRPTPKGTVMDIISRKDQRGSGQVGTYGLNTFTNMEVQLIRQMEGEGVLSKADLENPHLLEKEITQWLETKGVERLKRMAISGDDCVVKPIDDRFADALLALNDMGKVRKDIPQWQPSKGWHDWQQVPFCSHHFHELIMKDGRKLVVPCRPQDELIGRARISQGAGWSLKETACLGKAYAQMWALMYFHRRDLRLASNAICSAVPVHWVPTSRTTWSIHAHHQWMTTEDMLTVWNRVWIEDNPWMEDKTPVTTWEDVPYLGKREDQWCGSLIGLASRATWAQNILTAIQQVRSLIGNEEFLDYMPSMKRFRKEEESEGAIW

SEQ ID NO: 5080 - protein, 3290 aa, Artificial Sequence
  derived and/or modified protein sequence (wt) from DENV-3__KC762684__SS-prME
TSLCLMMMLPATLAFHLTSRDGEPRMIVGKNERGKSLLFKTASGINMCTLIAMDLGEMCDDTVTYKCPLITEVEPEDIDCWCNLTSTWVTYGTCNQAGEHRRDKRSVALAPHVGMGLDTRAQTWMSAEGAWRQVEKVETWAFRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNVTTDSRCPTQGEAILPEEQDQNYVCKHTYVDRGWGNGCGLFGKGSLVTCAKFQCLELIEGKVVQHENLKYTVSITVHTGDQHQVGNETQGVTAEITPQASTVEAILPEYGTLGLECSPRTGLDFNEMILLTMKNKAWMVHRQWFFDLPLPWTSGATTETPTWNKKELLVTFKNAHAKKQEVVVLGSQEGAMHTALTGATEIQTSGGTSIFAGHLKCRLKMDKLELKGMSYAMCSNAFVLKKEVSETQHGTILIKVEYKGEDAPCKIPFSTEDGQGKAHNGRLITANPVVTKKEEPVNIEAEPPFGESNIIIGIGDKALKINWYKKGSSIGKMFEATARGARRMAILGDTAWDFGSVGGVLNSLGKMVHQIFGSAYTALFSGVSWIMKIGIGVLLTWIGLNSKNTSMSFSCIVIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDIIGILEQGKRTLTPQPMELKYSWKTWGKAKIVTAEMQNSSFIIDGPNTPECPNASRAWNVWEVEDYGFGVFTTNIWLKLREMYTQLCDHRLMSAAIKDERAVHADMGYWIESQKNGSWKLEKASLIEVKTCTWPKSHTLWSNGVLESDMIIPKSLAGPISQHNYRPGYHTQTAGPWHLGKLELDFNYCEGTTVVITENCGTRGPSLRTTTVSGKLIHEWCCRSCTLPPLRYMGEDGCWYGMEIRPINEREENMVKSLVSAGSGKVDNFTMGVLCLAILFEEVMRGKFGKKHMIAGVFFTFVLLLSGQITWRDMARTLIMIGSNASDRMGMGVTYLALIATFKIQPFLALGFFLRKLTSRENLLLGVGLAMATTLQLPEDIEQMANGIALGLMALKLVTQFETYQLWTALVSLMCSNTIFTLTVAWRTATLILAGISLLPLCQSSGMRKTDWLPMTVAAMGVPPLPLFIFSLKDTLKRRSWPLNEGVMAVGLVSILASSLLRNDVPMAGPLVAGGLLIACYVITGTSADLTVEKAADVTWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTYNGKRLEPNWASVKKDLISYGGGWRLSAQWQKGEEVQVIAVEPGKNPKNFQTMPGIFQTTTGEIGAIALDFKPGTSGSPIINREGKVVGLYGNGVVTKNGGYVSGIAQTSAEPDGPTPELEEEMFKKRNLTIMDLHPGSGKTRKYLPAIVREAIKRRLRTLILAPTRVVAAEMEEALKGLPIRYQTTATKSEHTGKEIVDLMCHATFTMRLLSPVRVPNYNLIIMDEAHFTDPASIAARGYISTRVGMGEAAAIFMTATPPGTADAFPQSNAPIQDEERDIPERSWNSGNDWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTVASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGERNNQILEENMDVEIWTKEGEKKKLRPRWLDARTYSDPLALKEFKDFAAGRKSIALDLVTEIGRVPSHLAHRTRNALDNLVMLHTSEHGGRAYRHAVEELPETMETLLLLGLMILLTGGVMLFLISGKGVGKTSIGLICVVASSSMLWMADIPLQWIASAIVLEFFMMVLLIPEPEKQRTPQDNQLAYVVIGILTLAAIVAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLVTHYAIIGPGLQAKATREAQKRTAAGIMKNPTVDGIMTIDLDPVIYDSKFEKQLGQVMLLVLCAVQLLLMRTSWAFCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPAVIEHLERLQRKHGGMLVRNPLSRNSTHEMYWISNGTGNIVSSVNMVSRLLLNRFTMTYRRPTIEKDVDLGAGTRHVNAEPETPNMDVIGERIRRIKEEHSSTWHYDDENPYKTWAYHGSYEVKATGSASSMINGVVKLLTKPWDVVPTVTQMAMTDTTPFGQQRVFKEKVDTRTPKPMPGTRKVMEITAEWLWRTLGRNKRPRLCTREEFTKKVRTNAAMGAVFTEENQWDSARAAVEDEEFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPKGTVMDIISRKDQRGSGQVGTYGLNTFTNMEAQLIRQMEGEGVLSKTDLENPHLLEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLKETACLGKAYAQMWALMYFHRRDLRLASNAICSAVPVHWVPTSRTTWSIHAHHQWMTTEDMLTVWNRVWIEDNPWMEDKTPVTTWEDVPYLGKREDQWCGSLIGLTSRATWAQNILTAIQQVRSLIGNEEFLDYMPSMKRFRKEEESEGAIW

SEQ ID NO: 5081 - protein, 3290 aa, Artificial Sequence
  derived and/or modified protein sequence (wt) from DENV-3__KC762686__SS-prME
TSLCLMMMLPATLAFHLTSRDGEPRMIVGKNERGKSLLFKTASGINMCTLIAMDLGEMCDDTVTYKCPLITEVEPEDIDCWCNLTSTWVTYGTCNQAGEHRRDKRSVALAPHVGMGLDTRAQTWMSAEGAWRQVEKVETWAFRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNVTTDSRCPTQGEAILPEEQDQNYVCKHTYVDRGWGNGCGLFGKGSLVTCAKFQCLEFIEGKVVQHENLKYTVIITVHTGDQHQVGNETQGVTAEITPQASTVEAILPEYGTLGLECSPRTGLDFNEMILLTMKNKAWMVHRQWFFDLPLPWTSGATTETPTWNKKELLVTFKNAHAKKQEVVVLGSQEGAMHTALTGATEIQTSGGTSIFAGHLKCRLKMDKLELKGMSYAMCLNAFVLKKEVSETQHGTILIKVEYKGEDAPCKIPFSTEDGQGKAHNGRLITANPVVTKKEEPINIEAEPPFGESNIVIGIGDKALKINWYKKGSSIGKMFEATARGARRMAILGDTAWDFGSVGGVLNSLGKMVHQIFGSAYTALFSGVSWIMKIGIGVLLTWIGLNSKNTSMSFSCIVIGIITLYLGAVVQADMGCVINWKGKELKCGSGIFVTNEVHTWTEQYKFQADSPKRLATTIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSASRAWNVWEVEDYGFGVFTTNIWLKLREMYTQLCDHRLMSAAVKDERAVHADMGYWIESQKNGSWKLEKASLIEVKTCTWPKSHTLWSNGVLESDMIIPKSLAGPVSQHNHRPGYHTQTAGPWHLGKLELDFNYCEGTTVVITENCGTRGPSLRTTTVSGKLIHEWCCRSCTLPPLRYMGEDGCWYGMEIRPINEKEENMVKSLVSAGSGKVDNFTMGVLCLAILFEEVMRGKFGKKHMIAGVLFTFVLLLSGQITWRDMARTLIMIGSNASDRMGMGVTYLALIATFKIQPFLALGFFLRKLTSRENLLLGVGLAMATTLQLPEDIEQMANGIALGLMALKLITQFETYQLWTALVSLMCSNTIFTLTVAWRTATLILAGISLLPVCQSSSMRKTDWLPVTVAAMGVPPLPLFIFSLKDTLKRRSWPLNEGVMAVGLVSILASSLLRNDVPMAGPLVAGGLLIACYVITGTSADLTVEKAADVIWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTHNGKRLEPNWASVKKDLISYGGGWRLSAQWQKGEEVQVIAVEPGKNPKNFQTMPGIFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSAHTGKEIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTVASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGERNNQILEENMDVEIWTKEGEKKKLRPRWLDARTYSDPLALKEFKDFAAGRKSIALDLVTEIGRVPSHLAHRTRNALDNLVMLHTSEHGGRAYRHAVEELPETMETLLLLGLMILLTGGAMLFLISGKGIGKTSIGLICVVASSGMLWMADVPLQWIASAIVLEFFMMVLLIPEPEKQRTPQDNQLAYVVIGILTLAAIVAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLVTHYAIIGPGLQAKATREAQKRTAAGIMKNPTVDGIMTIDLDPVIYDSKFEKQLGQVMLLVLCAVQLLLMRTSWAFCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVSSVNMVSRLLLNRFTMTHRRPTIEKDVDLGAGTRHVNAEPETPNMDVIGERIRRIKEEHSSTWHYDEENPYKTWAYHGSYEVKATGSASSMINGVVKLLTKPWDVVPTVTQMAMTDTTPFGQQRVFKEKVDTRTPRPMPGTRKAMEITAEWLWRTLGRNKRPRLCTREEFTKKVRTNAAMGAVFTEENQWDSARAAVEDEEFWKLVDRERELHKLGKCGSCVYNMMGKREKKLGEFGKAKGSRAIWYMWLGARYLEFEALGFLNEDHWFSRENSFSGVEGEGLHKLGYILRDISKIPGGAMYADDTAGWDTRITEDDLHNEEKITQQMEPEHRQLANAIFKLTYQNKVVKVQRPTPKGTVMDIISRKDQRGSGQVGTYGLNTFTNMEVQLIRQMEGEGVLSKADLENPHLLEKEITQWLETKGVERLKRMAISGDDCVVKPIDDRFADALLALNDMGKVRKDIPQWQPSKGWHDWQQVPFCSHHFHELIMKDGRKLVVPCRPQDELIGRARISQGAGWSLKETACLGKAYAQMWALMYFHRRDLRLASNAICSAVPVHWVPTSRTTWSIHAHHQWMTTEDMLTVWNRVWIEDNPWMEDKTPVTTWEDVPYLGKREDQWCGSLIGLASRATWAQNILTAIQQVRSLIGNEEFLDYMPSMKRFRKEEESEGAIW

SEQ ID NO: 5082 - protein, 3290 aa, Artificial Sequence
  derived and/or modified protein sequence (wt) from DENV-3__KC762685__SS-prME
TSLCLMMMLPATLAFHLTSRDGEPRMIVGKNERGKSLLFKTASGINMCTLIAMDLGEMCDDTVTYKCPLITEVEPEDIDCWCNLTSTWVTYGTCNQAGEHRRDKRSVALAPHVGMGLDTRAQTWMSAEGAWRQVEKVETWAFRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNVTTDSRCPTQGEAILPEEQDQNYVCKHTYVDRGWGNGCGLFGKGSLVTCTKFQCLEFIEGKVVQHENLKYTVIITVHTGDQHQVGNETQGVTAEITPQASTVEAILPEYGTLGLECSPRTGLDFNEMILLTMKNKAWMVHRQWFFDLPLPWTSGATTETPTWNKKELLVTFKNAHAKKQEVVVLGSQEGAMHTALTGATEIQTSGGTSIFAGHLKCRLKMDKLELKGMSYAMCLNAFVLKKEVSETQHGTILIKVEYKGEDAPCKIPFSTEDGQGKAHNGRLITANPVVTKKEEPVNIEAEPPFGESNIVIGIGDKALKINWYKKGSSIGKMFEATARGARRMAILGDTAWDFGSVGGVLNSLGKMVHQIFGSAYTALFSGVSWIMKIGIGVLLTWIGLNSKNTSMSFSCIVIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSASRAWNVWEVEDYGFGVFTTNIWLKLREMYTQLCDHRLMSAAVKDERAVHADMGYWIESQKNGSWKLEKASLIEVKTCTWPKSHTLWSNGVLESDMIIPKSLAGPVSQHNYRPGYHTQTAGPWHLGKLELDFNYCEGTTVVITENCGTRGPSLRTTTVSGKLIHEWCCRSCTLPPLRYMGEDGCWYGMEIRPINEKEENMVKSLVSAGSGKVDNFTMGVLCLAILFEEVMRGKFGKKHMIAGVLFTFVLLLSGQITWRDMARTLIMIGSNASDRMGMGVTYLALIATFKIQPFLALGFFLRKLTSRENLLLGVGLAMATTLQLPEDIEQMANGIALGLMALKLITQFETYQLWTALVSLMCSNTIFTLTVAWRTATLILAGISLLPVCQSSSMRKTDWLPVTVAAMGVPPLPLFIFSLKDTLKRRSWPLNEGVMAVGLVSILASSLLRNDVPMAGPLVAGGLLIACYVITGTSADLTVEKAADVIWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTHNGKRLEPNWASVKKDLISYGGGWRLSAQWQKGEEVQVIAVEPGKNPKNFQTMPGIFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSAHTGKEIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTVASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGERNNQILEENMDVEIWTKEGEKKKLRPRWLDARTYSDPLALKEFKDFAAGRKSIALDLVTEIGRVPSHLAHRTRNALDNLVMLHTSEHGGRAYRHAVEELPETMETLLLLGLMILLTGGAMLFLISGKGIGKTSIGLICVVASSGMLWMADVPLQWIASAIVLEFFMMVLLIPEPEKQRTPQDNQLAYVVIGILTLAAIVAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLVTHYAIIGPGLQAKATREAQKRTAAGIMKNPTVDGIMTIDLDPVIYDSKFEKQLGQVMLLVLCAVQLLLMRTSWAFCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVSSVNMVSRLLLNRFTMTHRRPTIEKDVDLGAGTRHVNAEPETPNMDVIGERIRRIKEEHSSTWHYDEENPYKTWAYHGSYEVKATGSASSMINGVVKLLTKPWDVVPTVTQMAMTDTTPFGQQRVFKEKVDTRTPRPMPGTRKAMEITAEWLWRTLGRNKRPRLCTREEFTKKVRTNAAMGAVFTEENQWDSARAAVEDEEFWKLVDRERELHKLGKCGSCVYNMMGKREKKLGEFGKAKGSRAIWYMWLGARYLEFEALGFLNEDHWFSRENSFSGVEGEGLHKLGYILRDISKIPGGAMYADDTAGWDTRITEDDLHNEEKITQQMEPEHRQLANAIFKLTYQNKVVKVQRPTPKGTVMDIISRKDQRGSGQVGTYGLNTFTNMEVQLIRQMEGEGVLSKADLENPHLLEKEITQWLETKGVERLKRMAISGDDCVVKPIDDRFADALLALNDMGKVRKDIPQWQPSKGWHDWQQVPFCSHHFHELIMKDGRKLVVPCRPQDELIGRARISQGAGWSLKETACLGKAYAQMWALMYFHRRDLRLASNAICSAVPVHWVPTSRTTWSIHAHHQWMTTEDMLTVWNRVWIEDNPWMEDKTPVTTWEDVPYLGKREDQWCGSLIGLASRATWAQNILTAIQQVRSLIGNEEFLDYMPSMKRFRKEEESEGAIW

SEQ ID NO: 5083 - protein, 3290 aa, Artificial Sequence
  derived and/or modified protein sequence (wt) from DENV-3__KC762687__SS-prME
TSLCLMMMLPATLAFHLTSRDGEPRMIVGKNERGKSLLFKTASGINMCTLIAMDLGEMCDDTVTYKCPLITEVEPEDIDCWCNLTSTWVTYGTCNQAGEHRRDKRSVALAPHVGMGLDTRAQTWMSAEGAWRQVEKVETWAFRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNVTTDSRCPTQGEAILPEEQDQNYVCKHTYVDRGWGNGCGLFGKGSLVTCAKFQCLEFIEGKVVQHENLKYTVIITVHTGDQHQVGNETQGVTAEITPQASTVEAILPEYGTLGLECSPRTGLDFNEMILLTMKNKAWMVHRQWFFDLPLPWTSGATTETPTWNKKELLVTFKNAHAKKQEVVVLGSQEGAMHTALTGATEIQTSGGTSIFAGHLKCRLKMDKLELKGMSYAMCLNAFVLKKEVSETQHGTILIKVEYKGEDAPCKIPFSTEDGQGKAHNGRLITANPVVVKKEEPVNIEAEPPFGESNIVIGIGDKALKINWYKKGSSIGKMFEATARGARRMAILGDTAWDFGSVGGVLNSLGKMVHQIFGSAYTALFSGVSWIMKIGIGVLLTWIGLNSKNTSMSFSCIVIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSASRAWNVWEVEDYGFGVFTTNIWLKLREMYTQLCDHRLMSAAVKDERAVHADMGYWIESQKNGSWKLEKASLIEVKTCTWPKSHTLWSNGVLESDMIIPKSLAGPVSQHNYRPGYHTQTAGPWHLGKLELDFNYCEGTTVVITENCGTRGPSLRTTTVSGKLIHEWCCRSCTLPPLRYMGEDGCWYGMEIRPINEKEENMVKSLVSAGSGKVDNFTMGVLCLAILFEEVMRGKFGKKHMIAGVLFTFVLLLSGQITWRDMARTLIMIGSNASDRMGMGVTYLALIATFKIQPFLALGFFLRKLTSRENLLLGVGLAMATTLQLPEDIEQMANGIALGLMALKLITQFETYQLWTALVSLMCSNTIFTLTVAWRTATLILAGISLFPVCQSSSMRKTDWLPVTVAAMGVPPLPLFIFSLKDTLKRRSWPLNEGVMAVGLVSILASSLLRNDVPMAGPLVAGGLLIACYVITGTSADLTVEKAADVIWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTHNGKRLEPNWASVKKDLISYGGGWRLSAQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSVHTGKEIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTVASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGERNNQILEENMDVEIWTKEGEKKKLRPRWLDARTYSDPLALKEFKDFAAGRKSIALDLVTEIGRVPSHLAHKTRSALDNLVMLHTSEHGGRAYRHAVEELPETMETLLLLGLMILLTGGAMLFLISGKGIGKTSIGLICVVASSGMLWMADVPLQWIASAIVLEFFMMVLLIPEPEKQRTPQDNQLAYVVIGILTLAAIVAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLVTHYAIIGPGLQAKATREAQKRTAAGIMKNPTVDGIMTIDLDPVIYDSKFEKQLGQVMLLVLCAVQLLLMRTSWAFCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVSSVNMVSRLLLNRFTMTHRRPTIEKDVDLGAGTRHVNAEPETPNMDVIGERIRRIKEEHSSTWHYDEENPYKTWAYHGSYEVKATGSASSMINGVVKLLTKPWDVVPTVTQMAMTDTTPFGQQRVFKEKVDTRTPRPMPGTRKAMEITAEWLWRTLGRNKRPRLCTREEFTKKVRTNAAMGAVFTEENQWDSAKAAVEDEEFWKLVDRERELHKLGKCGSCVYNMMGKREKKLGEFGKAKGSRAIWYMWLGARYLEFEALGFLNEDHWFSRENSFSGVEGEGLHKLGYILRDISKIPGGAMYADDTAGWDTRITEDDLHNEEKITQQMDPEHRQLANAIFKLTYQNKVVKVQRPTPKGTVMDIISRKDQRGSGQVGTYGLNTFTNMEVQLIRQMEGEGVLSKADLENPHLLEKEITQWLETKGVERLKRMAISGDDCVVKPIDDRFADALLALNDMGKVRKDIPQWQPSKGWHDWQQVPFCSHHFHELIMKDGRKLVVPCRPQDELIGRARISQGAGWSLRETACLGKAYAQMWALMYFHRRDLRLASNAICSAVPVHWVPTSRTTWSIHAHHQWMTTEDMLTVWNRVWIEDNPWMEDKTPVTTWEDVPYLGKREDQWCGSLIGLASRATWAQNILTAIQQVRSLIGNEEFLDYMPSMKRFRKEEESEGAIW

SEQ ID NO: 5084 - protein, 3290 aa, Artificial Sequence
  derived and/or modified protein sequence (wt) from DENV-3__KC762688__SS-prME
TSLCLMMMLPATLAFHLTSRDGEPRMIVGKNERGKSLLFKTASGINMCTLIAMDLGEMCDDTVTYKCPLITEVEPEDIDCWCNLTSTWVTYGTCNQAGEHRRDKRSVALAPHVGMGLDTRAQTWMSAEGAWRQVEKVETWAFRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNVTTDSRCPTQGEAILPEEQDQNYVCKHTYVDRGWGNGCGLFGKGSLVTCAKFQCLEFIEGKVVQHENLKYTVIITVHTGDQHQVGNETQGVTAEITPQASTVEAILPEYGTLGLECSPRTGLDFNEMILLTMKNKAWMVHRQWFFDLPLPWTSGATTETPTWNKKELLVTFKNAHAKKQEVVVLGSQEGAMHTALTGATEIQTSGGTSIFAGHLKCRLKMDKLELKGMSYAMCLNAFVLKKEVSETQHGTILIKVEYKGEDAPCKIPFSTEDGQGKAHNGRLITANPVVTKKEEPVNIEAEPPFGESNIVIGIGDKALKINWYKKGSSIGKMFEATARGARRMAILGDTAWDFGSVGGVLNSLGKMVHQIFGSAYTALFSGVSWIMKIGIGVLLTWIGLNSKNTSMSFSCIVIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSASRAWNVWEVEDYGFGVFTTNIWLKLREMYTQLCDHRLMSAAVKDERAVHADMGYWIESQKNGSWKLEKASLIEVKTCTWPKSHTLWSNGVLESDMIIPKSLAGPVSQHNYRPGYHTQTAGPWHLGKLELDFNYCEGTTVVITENCGTRGPSLRTTTVSGKLIHEWCCRSCTLPPLRYMGEDGCWYGMEIRPINEKEENMVKSLVSAGSGKVDNFTMGVLCLAILFEEVMRGKFGKKHMIAGVLFTFVLLLSGQITWRDMARTLIMIGSNASDRMGMGVTYLALIATFKIQPFLALGFFLRKLTSRENLLLGVGLAMATTLQLPEDIEQMANGIALGLMALKLITQFETYQLWTALVSLMCSNTLFTLTVAWRTATLILAGISLLPVCQSSSMRKTDWLPVTVAAMGVPPLPLFIFSLKDTLKRRSWPLNEGVMAVGLVSILASSLLRNDVPMAGPLVAGGLLIACYVITGTSADLTVEKAADVIWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTHNGKRLEPNWASVKKDLISYGGGWRLSAQWQKGEEVQVIAVEPGKNPKNFQTMPGIFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSAHTGKEIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTVASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGERNNQILEENMDVEIWTKEGEKKKLRPRWLDARTYSDPLALKEFKDFAAGRKSIALDLVTEIGRVPSHLAHRTRNALDNLVMLHTSEHGGRAYRHAVEEFPETMETLLLLGLMILLTGGAMLFLISGKGIGKTSIGLICVVASSGMLWMADVPLQWIASAIVLEFFMMVLLIPEPEKQRTPQDNQLAYVVIGILTLAAIVAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLVTHYAIIGPGLQAKATREAQKRTAAGIMKNPTVDGIMTIDLDPVIYDSKFEKQLGQVMLLVLCAVQLLLMRTSWAFCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKKGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVSSVNMVSRLLLNRFTMTHRRPTIEKDVDLGAGTRHVNAEPETPNMDVIGERIRRIKEEHSSTWHYDEENPYKTWAYHGSYEVKATGSASSMINGVVKLLTKPWDVVPTVTQMAMTDTTPFGQQRVFKEKVDTRTPRPMPGTRKAMEITAEWLWRTLGRNKRPRLCTREEFTKKVRTNAAMGAVFTEENQWDSARAAVEDEEFWKLVDRERELHKLGKCGSCVYNMMGKREKKLGEFGKAKGSRAIWYMWLGARYLEFEALGFLNEDHWFSRENSFSGVEGEGLHKLGYILRDISKIPGGAMYADDTAGWDTRITEDDLHNEEKITQQMDPEHRQLANAIFKLTYQNKVVKVQRPTPKGTVMDIISRKDQRGSGQVGTYGLNTFTNMEVQLIRQMEGEGVLSKADLENPHLLEKEITQWLETKGVERLKRMAISGDDCVVKPIDDRFADALLALNDMGKVRKDIPQWQPSKGWHDWQQVPFCSHHFHELIMKDGRKLVVPCRPQDELIGRARISQGAGWSLKETACLGKAYAQMWALMYFHRRDLRLASNAICSAVPVHWVPTSRTTWSIHAHHQWMTTEDMLTVWNRVWIEDNPWIEDKTPVTTWEDVPYLGKREDQWCGSLIGLASRATWAQNILTAIQQVRSLIGNEEFLDYMPSMKRFRKEEESEGAIW

SEQ ID NO: 5085 - protein, 3290 aa, Artificial Sequence
  derived and/or modified protein sequence (wt) from DENV-3__KC762689__SS-prME
TSLCLMMMIPATLAFHLTSRDGEPRMIVGKNERGKSLLFKTASGINMCTLIAMDLGEMCDDTVTYKCPLITEVEPEDIDCWCNLTSTWVTYGTCNQAGEHRRDKRSVALAPHVGMGLDTRAQTWMSAEGAWRQVEKVETWAFRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNVTTDSRCPTQGEAILPEEQDQNYVCKHTYVDRGWGNGCGLFGKGSLVTCAKFQCLEFIEGKVVQHENLKYTVIITVHTGDQHQVGNETQGVTAEITPQASTVEAILPEYGTLGLECSPRTGLDFNEMILLTMKNKAWMVHRQWFFDLPLPWTSGATTETPTWNKKELLVTFKNAHAKKQEVVVLGSQEGAMHTALTGATEIQTSGGTSIFAGHLKCRLKMDKLELKGMSYAMCLNAFVLKKEVSETQHGTILIKVEYKGEDAPCKIPFSTEDGQGKAHNGRLITANPVVTKKEEPVNIEAEPPFGESNIVIGIGDKALKINWYKKGSSIGKMFEATARGARRMAILGDTAWDFGSVGGVLNSLGKMVHQIFGSAYTALFSGVSWIMKIGIGVLLTWIGLNSKNTSMSFSCIVIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSASRAWNVWEVEDYGFGVFTTNIWLKLREMYTQLCDHRLMSAAVKDERAVHADMGYWIESQKNGSWKLEKASLIEVKTCTWPKSHTLWSNGVLESDMIIPKSLAGPVSQHNYRPGYHTQTAGPWHLGKLELDFNYCEGTTVVITESCGTRGPSLRTTTVSGKLIHEWCCRSCTLPPLRYMGEDGCWYGMEIRPINEKEENMVKSLVSAGSGKVDNFTMGVLCLAILFEEVMRGKFGKKHMIAGVLFTFVLLLSGQITWRDMARTLIMIGSNASDRMGMGVTYLALIATFKIQPFLALGFFLRKLTSRENLLLGVGLAMATTLQLPEDIEQMANGIALGLMALKLITQFETYQLWTALVSLMCSNTIFTLTVAWRTATLILAGISLLPVCQSSSMRKTDWLPVTVAAMGVPPLPLFIFSLKDTLKRRSWPLNEGVMAVGLVSILASSLLRNDVPMAGPLVAGGLLIACYVITGTSADLTVEKAADVIWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTHNGKRLEPNWASVKKDLISYGGGWRLSAQWQKGEEVQVVAVEPGKNPKNFQTMPGIFQTTTGEIGAIALDFKPGTSGSPIINREGKVVGLYGNGVVTKNGGYVSGIAQTNAEPDGPTPDLEEEMFKKRNLTIMDLHPGSGKTRKYLPAIVREAIKRRLRTLILAPTRVVAAEMEEALKGLPIRYQTTATKSVHTGKEIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTVASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGERNNQILEENMDVEIWTKEGEKKKLRPRWLDARTYSDPLALKEFKDFAAGRKSIALDLVTEIGRVPSHLAYRTRNALDNLVMLHTSEHGGRAYRHAVEELPETMETLLLLGLMILLTGGAMLFLISGKGIGKTSIGLICVVASSGMLWMADVPLQWIASAIVLEFFMMVLLIPEPEKQRTPQDNQLAYVVIGILTLAAIVAANEMGLLETTKRDLGMSKEPGVVSPTSYLDVDLHPASAWTLYAVATTVITPMLRHTIENSTANVSLAAIANQAVVLMGLDKGWPISKVDLGVPLLALGCYSQVNPLTLTAAVLLLVTHYAIIGPGLQAKATREAQKRTAAGIMKNPTVDGIMTIDLDPVIYDSKFEKQLGQVMLLVLCAVQLLLMRTSWAFCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGETTHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVSSVNMVSRLLLNRFTMTHRRPTIEKDVDLGAGTRHVNAEPETPNMDVIGERIRRIKEEHSSTWHYDEENPYKTWAYHGSYEVKATGSASSMINGVVKLLTKPWDVVPTVTQMAMTDTTPFGQQRVFKEKVDTRTPRPMPGTRKAMEITAEWLWRTLGRNKRPRLCTREEFTKKVRTNAAMGAVFTEENQWDSARAAVEDEEFWKLVDRERELHKLGKCGSCVYNMMGKREKKLGEFGKAKGSRAIWYMWLGARYLEFEALGFLNEDHWFSRENSFSGVEGEGLHKLGYILRDISKIPGGAMYADDTAGWDTRITEDDLHNEEKITQQMDPEHRQLANAIFKLTYQNKVVKVQRPTPKGTVMDIISRKDQRGSGQVGTYGLNTFTNMEVQLIRQMEGEGVLSKADLENPHLLEKEITQWLETKGVERLKRMAISGDDCVVKPIDDRFADALLALNDMGKVRKDIPQWQPSKGWHDWQQVPFCSHHFHELIMKDGRKLVVPCRPQDELIGRARISQGAGWSLKETACLGKAYAQMWALMYFHRRDLRLASNAICSAVPVHWVPTSRTTWSIHAHHQWMTTEDMLTVWNRVWIEDNPWMEDKTPVTTWEDVPYLGKREDQWCGSLIGLASRATWAQNILTAIQQVRSLIGNEEFLDYMPSMKRFRKEEESEGAIW

SEQ ID NO: 5086 - protein, 3290 aa, Artificial Sequence
  derived and/or modified protein sequence (wt) from DENV-3__KC762690__SS-prME
TSLCLMMMLPATLAFHLTSRDGEPRMIVGKNERGKSLLFKTASGINMCTLIAMDLGEMCDDTVTYKCPLITEVEPEDIDCWCNLTSTWVTYGTCNQAGEHRRDKRSVALAPHVGMGLDTRAQTWMSAEGAWRQVEKVETWAFRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNVTTDSRCPTQGEAILPEEQDQNYVCKHTYVDRGWGNGCGLFGKGSLVTCAKFQCLEFIEGKVVQHENLKYTVIITVHTGDQHQVGNETQGVTAEITPQASTVEAILPEYGTLGLECSPRTGLDFNEMILLTMKNKAWMVHRQWFFDLPLPWTSGATTETPTWNKKELLVTFKNAHAKKQEVVVLGSQEGAMHTALTGATEIQTSGGTSIFAGHLKCRLKMDKLELKGMSYAMCLNAFVLKKEVSETQHGTILIKVEYKGEDAPCKIPFSTEDGQGKAHNGRLITANPVVTKKEEPVNIEAEPPFGESNIVIGIGDKALKINWYKKGSSIGKMFEATARGARRMAILGDTAWDFGSVGGVLNSLGKMVHQIFGSAYTALFSGVSWIMKIGIGVLLTWIGLNSKNTSMSFSCIVIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSASRAWNVWEVEDYGFGVFTTNIWLKLREMYTQLCDHRLMSAAVKDERAVHADMGYWIESQKNGSWKLEKASLIEVKTCTWPKSHTLWSNGVLESDMIIPKSLAGPVSQHNYRPGYHTQTAGPWHLGKLELDFNYCEGTTVVITENCGTRGPSLRTTTVSGKLIHEWCCRSCTLPPLRYMGEDGCWYGMEIRPINEKEENMVKSLVSAGSGKVDNFTMGVLCLAILFEEVMRGKFGKKHMIAGVLFTFVLLLSGQITWRDMARTLIMIGSNASDRMGMGVTYLALIATFKIQPFLALGFFLRKLTSRENLLLGVGLAMATTLQLPEDIEQMANGIALGLMALKLITQFETYQLWTALVSLMCSNTIFTLTVAWRTATLILAGISLLPVCQSSSMRKTDWLPVTVAAMGVPPLPLFIFSLKDTLKRRSWPLNEGVMAVGLVSILASSLLRNDVPMAGPLVAGGLLIACYVITGTSADLTVEKAADVIWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTHNGKRLEPNWASVKKDLISYGGGWRLSAQWQKGEEVQVIAVEPGKNPKNFQTMPGIFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSAHTGKEIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTVASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGERNNQILEENMDVEIWTKEGEKKKLRPRWLDARTYSDPLALKEFKDFAAGRKSIALDLVTEIGRVPSHLAHRTRNALDNLVMLHTSEHGGRAYRHAVEELPETMETLLLLGLMILLTGGAMLFLISGKGIGKTSIGLICVVASSGMLWMADVPLQWIASAIVLEFFMMVLLIPEPEKQRTPQDNQLAYVVIGILTLAAIVAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLVTHYAIIGPGLQAKATREAQKRTAAGIMKNPTVDGIMTIDLDPVIYDSKFEKQLGQVMLLVLCAVQLLLMRTSWAFCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVSSVNMVSRLLLNRFTMTHRRPTIEKDVDLGAGTRHVNAEPETPNMDVIGERIRRIKEEHSSTWHYDEENPYKTWAYHGSYEVKATGSASSMINGVVKLLTKPWDVVPTVTQMAMTDTTPFGQQRVFKEKVDTRTPRPMPGTRKAMEITAEWLWRTLGRNKRPRLCTREEFTKKVRTNAAMGAVFTEENQWDSARAAVEDEEFWKLVDRERELHKLGKCGSCVYNMMGKREKKLGEFGKAKGSRAIWYMWLGARYLEFEALGFLNEDHWFSRENSFSGVEGEGLHKLGYILRDISKIPGGAMYADDTAGWDTRITEDDLHNEEKITQQMEPEHRQLANAIFKLTYQNKVVKVQRPTPKGTVMDIISRKDQRGSGQVGTYGLNTFTNMEVQLIRQMEGEGVLSKADLENPHLLEKEITQWLETKGVERLKRMAISGDDCVVKPIDDRFADALLALNDMGKVRKDIPQWQPSKGWHDWQQVPFCSHHFHELIMKDGRKLVVPCRPQDELIGRARISQGAGWSLKETACLGKAYAQMWALMYFHRRDLRLASNAICSAVPVHWVPTSRTTWSIHAHHQWMTTEDMLTVWNRVWIEDNPWMEDKTPVTTWEDVPYLGKREDQWCGSLIGLASRATWAQNILTAIQQVRSLIGNEEFLDYMPSMKRFRKEEESEGAIW

SEQ ID NO: 5087 - protein, 3290 aa, Artificial Sequence
  derived and/or modified protein sequence (wt) from DENV-3__KC762691__SS-prME
TSLCLMMMLPATLAFHLTSRDGEPRMIVGKNERGKSLLFKTASGINMCTLIAMDLGEMCDDTVTYKCPLITEVEPEDIDCWCNLTSTWVTYGTCNQAGEHRRDKRSVALAPHVGMGLDTRAQTWMSAEGAWRQVEKVETWAFRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNVTTDSRCPTQGEAILPEEQDQNYVCKHTYVDRGWGNGCGLFGKGSLVTCAKFQCLELIEGKVVQHENLKYTVIITVHTGDQHQVGNETQGVTAEITPQASTVEAILPEYGTLGLECSPRTGLDFNEMILLTMKDKAWMVHRQWFFDLPLPWTSGATTETPTWNKKELLVTFKNAHAKKQEVVVLGSQEGAMHTALTGATEIQTSGGTSIFAGHLKCRLKMDKLELKGMSYTMCSNAFVLKKEVSETQHGTILIKVEYKGEDAPCKIPFSTEDGQGKAHNGRLITANPVVTKKEEPVNIEAEPPFGESNIIIGIGDKALKINWYKKGSSIGKMFEATARGARRMAILGDTAWDFGSVGGVLNSLGKMVHQIFGSAYTALFSGVSWIMKIGIGVLLTWIGLNSKNTSMSFSCIVIGIITLYLGAVVQADMGCVINWKGKELKCGSGIFVTNEVHTWTEQYKFQADSPRRLATAIAGAWENGVCGIRSTTRMENLLWKQIANELNYILWENNIKLTVVVGDTIGVLEQGKRTLTPQPMELKYSWKTWGKAKIVTAETQNSSFIIDGPNTPECPNASRAWNVWEVEDYGFGVFTTNIWLKLREMYTQLCDHRLMSAAVKDERAVHADMGYWIESQKNGSWKLEKASLIEVKTCTWPKSHTLWSNGVLESDMIIPKSLAGPISQHNYRPGYHTQTAGPWHLGKLELDFNYCEGTTVVITENCGARGPSLRTTTVSGKLIHEWCCRSCTLPPLRYMGEDGCWYGMEIRPINEKEENMVKSLVSAGSGKVDNFTMGVLCLAILFEEVMRGKFGKKHMIAGVLFTFVLLLSGQITWRDMARTLIMIGSNASDRMGMGVTYLALIATFKIQPFLALGFFLRKLTSRENLLLGVGLAMATTLQLPEDIEQMANGIALGLMALKLITQFETYQLWTALVSLMCSNTIFTLTVAWRTATLILAGISLFPVCQSSSMRKTDWLPMTVAAMGVPPLPLFIFSLKDTLKRRSWPLNEGVMAVGLVSILASSLLRNDVPMAGPLVAGGLLIACYVITGTSADLTVEKAADVTWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTYNGKRLEPNWASVKKDLISYGGGWRLSAQWQKGEEVQVIAVEPGKNPKNFQTMPGIFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGKEIVDLMCHATFTMRLLSPVRVPNYNLIIMDEAHFTDPASIAARGYISTRVGMGEAAAIFMTATPPGTADAFPQSNAPIQDEERDIPERSWNSGNDWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTVASAAQRRGRIGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGERNNQILEENMDVEIWTKEGEKKKLRPRWLDARTYSDPLALKEFKDFAAGRKSIALDLVTEIGRVPSHLAHRTRNALDNLVMLHTSEHGGRAYRHAVEELPETMETLLLLGLMILLTGGAMLFLISGKGVGKTSIGLICVVASSGMLWMADIPLQWIASAIVLEFFMMVLLIPEPEKQRTPQDNQLAYVVIGILTLAAIVAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLVTHYAIIGPGLQAKATREAQKRTAAGIMKNPTVDGIMTIDLDPVIYDSKFEKQLGQVMLLVLCAVQLLLMRTSWAFCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVSSVNMVSRLLLNRFTMTYRRPTIEKDVDLGAGTRHVNAEPETPNMDVIGERIRRIKEEHSSTWHYDDENPYKTWAYHGSYEVKATGSASSMINGVVKLLTKPWDVVPTVTQMAMTDTTPFGQQRVFKEKVDTRTPKPMPGTRKVMEITAEWLWRTLGRNKRPRLCTREEFTKKVRTNAAMGAVFTEENQWDSARAAVEDEEFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPKGTVMDIISRKDQRGSGQVGTYGLNTFTNMEAQLIRQMEGEGVLSKTDLENPHLLEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLKETACLGKAYAQMWALMYFHRRDLRLASNAICSAVPVHWVPTSRTTWSIHAHHQWMTTEDMLTVWNRVWIEDNPWMEDKTPVTTWEDVPYLGKREDQWCGSLIGLTSRATWAQNILTAIQQVRSLIGNEEFLDYMPSMKRFRKEEESEGAIW

SEQ ID NO: 5088 - protein, 3290 aa, Artificial Sequence
  derived and/or modified protein sequence (wt) from DENV-3__KC762692__SS-prME
TSLCLMMMLPATLAFHLTSRDGEPRMIVGKNERGKSLLFKTASGINMCTLIAMDLGEMCDDTVTYKCPLITEVEPEDIDCWCNLTSTWVTYGTCNQAGEHRRDKRSVALAPHVGMGLDTRAQTWMSAEGAWRQVEKVETWAFRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNVTTDSRCPTQGEAILPEEQDQNYVCKHTYVDRGWGNGCGLFGKGSLVTCAKFQCLELIEGKVVQHENLKYTVIITVHTGDQHQVGNETQGVTAEITPQASTVEAILPEYGTLGLECSPRTGLDFNEMILLTMKNKAWMVHRQWFFDLPLPWTSGATTETPTWNKKELLVTFKNAHAKKQEVVVLGSQEGAMHTALTGATEIQTSGGTSIFAGHLKCRLKMDKLELKGMSYAMCSNAFVLKKEVSETQHGTILIKVEYKGEDAPCKIPFSTEDGQGKAHNGRLITANPVVTKKEEPVNIEAEPPFGESNIIIGIGDKALKINWYKKGSSIGKMFEATARGARRMAILGDTAWDFGSVGGVLNSLGKMVHQIFGSAYTALFSGVSWIMKIGIGVLLTWIGLNSKNTSMSFSCIVIGIITLYLGAVVQADMGCVINWKGKELKCGSGIFVTNEVHTWTEQYKFQADSPKRLATAIVGAWENGVCGIRSTTRMENLLWKQIANELNYILWENNIKLTVVVGDIIGVLEQGKRTLTPQPMELKYSWKTWGKAKIVTAEIQNSSFIIDGPNTPECPNASRAWNVWEVEDYGFGVFTTNIWLKLREMYTQLCDHRLMSAAVKDERAVHADMGYWIESQKNGSWKLEKASLIEVKTCTWPKSHTLWSNGVLESDMIIPKSLAGPISQHNYRPGYHTQTAGPWHLGKLELDFNYCEGTTVVITENCGTRGPSLRTTTVSGKLIHEWCCRSCTLPPLRYMGEDGCWYGMEIRPINEKEENMVKSLVSAGSGKVDNFTMGVLCLAILFEEVMRGKFGKKHMIAGVLFMFVLLLSGQITWRDMARTLIMIGSNASDRMGMGVTYLALIATFKIQPFLALGFFLRKLTSRENLLLGVGLAMATTLQLPEDIEQMANGIALGLMVLKLITQFETYQLWTALVSLTCSNTIFTLTVAWRTATLILAGTSLLPVCQSSSMRKTDWLPMTVAAMGVPPLPLFIFSLKDTLKRRSWPLNEGVMAVGLVSILASSLLRNDVPMAGPLVAGGLLIACYVITGTSADLTVEKAADVTWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTYNGKRLEPNWASVKKDLISYGGGWRLSAQWQKGEEVQVIAVEPGKNPKNFQTMPGIFQTITGEIGAIALDFKPGTSGSPIINREGKVVGLYGNGVVTKNGGYVSGIAQTNAEPDGPTPELEEEMFKKRNLTIMDLHPGSGKTRKYLPTIVREAIKRRLRTLILAPTRVVAAEMEEALKGLPIRYQTTATKSEHTGKEIVDLMCHATFTMRLLSPVRVPNYNLIIMDEAHFTDPASIAARGYISTRVGMGEAAAIFMTATPPGTADAFPQSNAPIQDEERDIPERSWNSGNDWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTVASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGERNNQILEENMDVEIWTKEGEKKKLRPRWLDARTYSDPLALKEFKDFAAGRKSIALDLVTEIGRVPSHLAHRTRNALDNLVMLHTSEHGGRAYRHAVEELPETMETLLLLGLMILLTGGAMLFLISGKGVGKTSIGLICVVASSGMLWMADIPLQWIASAIVLEFFMMVLLIPEPEKQRTPQDNQLAYVVIGILTLAAIVAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLVTHYAIIGPGLQAKATREAQKRTAAGIMKNPTVDGIMTIDLDPVIYDSKFEKQLGQVMLLVLCAVQLLLMRTSWAFCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVSSVNMVSRLLLNRFTMTYRRPTIEKDVDLGAGTRHVNAEPETPNMDVIGERIRRIKEEHSSTWHYDDENPYKTWAYHGSYEVKATGSASSMINGVVKLLTKPWDVVPTVTQMAMTDTTPFGQQRVFKEKVDTRTPKPMPGTRKIMEITAGWLWRTLGRNKRPRLCTREEFTKKVRTNAAMGAVFTEENQWDSARAAVEDEEFWKLVDRERELHKQGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPKGTVMDIISRKDQRGSGQVGTYGLNTFTNMEAQLIRQMEGEGVLSKTDLENPHLLEKKITQWLETKGVERLKRMAISGDDCVVKPIDDRFANALLALNDMGKVRKDIPQWQPSKGWHDWQQVPFCSHHFHELIMKDGRNLVVPCRPQDELIGRARISQGAGWSLKETACLGKAYAQMWALMYFHRRDLRLASNAICSAVPVHWVPTSRTTWSIHAHHQWMTTENMLTVWNRVWIEDNPWMEDKTPVTTWEDVPYLGKREDQWCGSLIGLTSRATWAQNILTAIQQVRSLIGNEEFLDYMPSMKRFRKEEESEGAIW

SEQ ID NO: 5089 - protein, 3290 aa, Artificial Sequence
  derived and/or modified protein sequence (wt) from DENV-3__JQ920481__SS-prME
TSLCLMMMLPATLAFHLTSRDGEPRMIVGKNERGKSLLFKTASGINMCTLIAMDLGEMCDDTVTYKCPLITEVEPEDIDCWCNLTSTWVTYGTCNQAGEHRRDKRSVALAPHVGMGLDTRTQTWMSAEGAWRQVEKVETWAFRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNVTTDSRCPTQGEAILPEEQDQNYVCKHTYVDRGWGNGCGLFGKGSLVTCAKFQCLESIEGKAVQHENLKYTVIITVHTGDQHQVGNETQGVTAEITPQASTVEAILPEYGTLGLECSPRTGLDFNEMILLTMKNKAWMVHRQWFFDLPLPWTSGATTETPTWNKKELLVTFKNAHAKKQEVVVLGSQEGAMHTALTGATEIQTSGGTSIFAGHLKCRLKMDKLELKGMSYAMCLNAFVLKKEVSETQHGTILIKVEYKGEDAPCKIPFSTEDGQGKAHNGRLITANPIVTKKEEPVNIEAEPPFGESNIVIGIGDKALKINWYKKGSSIGKMFEATARGARRMAILGDTAWDFGSVGGVLNSLGKMVHQIFGSAYTALFSGVSWIMKIGIGVLLTWIGLNSKNTSMSFSCIVIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDVIGVLEQGKRTLTPQPMELKYSWKTWGKAKIVTAETQNSSFIIDGPNTPECPSASRAWNVWEVEDYGFGVFTTNIWLKLREMYTQLCDHRLMSAAVKDERAVHADMGYWIESQKNGSWKLEKASLIEVKTCTWPKSHTLWSNGVLESDMIIPKSLAGPISQHNYRPGYHTQTAGPWHLGKLELDFNYCEGTTVVITENCGTRGPSLRTTTVSGKLIHEWCCRSCTLPPLRYMGEDGCWYGMEIRPINEKEENMVKSLVSAGSGKADNFTMGVLCLAILFEEVMRGKFGKKHMIAGALFTFVLLLSGQITWRDMAHTLIMIGSNASDRMGMGVTYLALIATFKIQPFLALGFFLRKLTSRENLLLGVGLAMATTLQLPEDIEQMANGIALGLMALKLITQFETYQLWTALVSLMCSNTIFTLTVAWRTATLILAVISLLPVCQSSSMRKTDWLPMTVAAMGVPPLPLFIFSLKDTLKRRSWPLNEGVMAVGLVSILASSFLRNDVPMAGPLVAGGLLIACYVITGTSADLTVEKAADVTWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTHNGKRLEPNWANVKKDLISYGGGWKLSAQWQKGEEVQVIAVEPGKNPKNFQTMPGIFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIVMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTVASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGERNNQILEENMDVEIWTKEGEKKKLRPRWLDARTYSDPLALKEFKDFAAGRKSIALDLVTEIGRVPSHLAHRTRNALDNLVMLHTSEHGGRAYRHAVEELPETMETLLLLGLMILLTGGAMLFLISGKGIGKTSIGLICVVASSGMLWMADVPLQWIASAIVLEFFMMVLLIPEPEKQRTPQDNQLAYVVIGILTLAAIVAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLVTHYAIIGPGLQAKATREAQKRTAAGIMKNPTVDGIMTIDLDPVIYDSKFEKQLGQVMLLVLCAVQLLLMRTSWAFCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVSSVNMVSRLLLNRFTMTHRRPTIEKDVDLGAGTRHVNAEPETPNMDVIGERIRRIKEEHSSTWHYDDENPYKTWAYHGSYEVKATGSASSMINGVVKLLTKPWDVVPMVTQMAMTDTTPFGQQRVFKEKVDTRTPRPMPGTRKVMEITAEWLWRTLGRNKRPRLCTREEFIKKVRTNAAMGAVFTEENQWDSARAAVEDEEFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPKGTVMDIISRKDQRGSGQVGTYGLNTFTNMEAQLIRQMEGEGVLSKADLENPHLLEKKVTQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLRETACLGKAYAQMWALMYFHRRDLRLASNAICSAVPVHWVPTSRTTWSIHAHHQWMTTEDMLTVWNRVWIEDNPWMEDKTPVTTWEDVPYLGKREDQWCGSLIGLTSRATWAQNILTAIQQVRSLIGNEEFLDYMPSMKRFRKEEESEGAIW

SEQ ID NO: 5090 - protein, 3290 aa, Artificial Sequence
  derived and/or modified protein sequence (wt) from DENV-3__JQ920483__SS-prME
TSLCLMMMLPATLAFHLTSRDGEPRMIVGKNERGKSLLFKTASGINMCTLIAMDLGEMCDDTVTYKCPLITEVEPEDIDCWCNLTSTWVTYGTCNQAGEHRRDKRSVALAPHVGMGLDTRTQTWMSAEGAWRQVEKVETWAFRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNVTTDSRCPTQGEAILPEEQNQNYVCKHTYVDRGWGNGCGLFGKGSLVTCAKFQCLESIEGKAVQHENLKYTVIITVHTGDQHQVGNETQGVTAEITPQASTVEAILPEYGTLGLECSPRTGLDFNEMILLTMKNKAWMVHRQWFFDLPLPWTSGATTETPTWNKKELLVTFKNAHAKKQEVVVLGSQEGAMHTALTGATEIQTSGGTSIFAGHLKCRLKMDKLELKGMSYAMCLNAFVLKKEVSETQHGTILIKVEYKGEDAPCKIPFSTEDGQGKAHNGRLITANPIVTKKEEPVNIEAEPPFGESNIVIGIGDKALKINWYKKGSSIGKMFEATARGARRMAILGDTAWDFGSVGGVLNSLGKMVHQIFGSAYTALFSGVSWIMKIGIGVLLTWIGLNSKNTSMSFSCIVIGIITLYLGAVVQADMGCVINWKGKELKCGSGIFVTNEVHTWTEQYKFQADSPKRLATAIAGAWENGVCGIRSTTRMENLLWKQIANELNYILWENNIKLTIVVGDVIGVLEQGKRTLTPQPMELKYSWKTWGKAKIVTAETQNSSFIIDGPNTPECPSASRAWNVWEVEDYGFGVFTTNIWLKLREKYTQLCDHRLMSAAVKDERAVHADMGYWIESQKNGSWKLEKASLIEVKTCTWPKSHTLWSNGVLESDMIIPKSLAGPISQHNYRPGYHTQTAGPWHLGKLELDFNYCEGTTVVITENCGIRGPSLRTTTVSGKLIHEWCCRSCTLPPLRYMGEDGCWYGMEIRPINEKEENMVKSLVSAGSGKTDNFTMGVLCLAILFEEVMRGKFGKKHMIAGALFTFVLLLSGQITWRDMAHTLIMIGSNASDRMGMGVTYLALIATFKIQPFLALGFFLRKLTSRENLLLGVGLAMATTLQLPEDIEQMANGIALGLMALKLITQFETYQLWTALISLMCSNTIFTLTVAWRTATLILAVISLLPVCQSSSMRKTDWLPMTVAAMGVPPLPLFIFSLKDTLKRRSWPLNEGVMAVGLVSILASSFLRNDVPMAGPLVAGGLLIACYVITGTSADLTVEKAADVTWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTHNGKRLEPNWANVKKDLISYGGGWKLSAQWQKGEEVQVIAVEPGKNPKNFQTMPGIFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIVMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTVASAAQRRGRVGRNSQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGERNNQILEENMDVEIWTKEGEKKKLRPRWLDARTYSDPLALKEFKDFAAGRKSIALDLVTEIGRVPSHLAHRTRNALDNLVMLHTSEHGGRAYRHAVEELPETMETLLLLGLMILLTGGAMLFLISGKGIGKTSIGLICVVASSGMLWMADVPLQWIASAIVLEFFMMVLLIPEPEKQRTPQDNQLAYVVIGILTLAAIVAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLVTHYAIIGPGLQAKATREAQKRTAAGIMKNPTVDGIMTIDLDPVIYDSKFEKQLGQVMLLVLCAVQLLLMRTSWAFCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVSSVNMVSRLLLNRFTMTHRRPTIEKDVDLGAGTRHVNAEPETPNMDVIGERIRRIKEEHSSTWHYDDENPYKTWAYHGSYEVKATGSASSMINGVVKLLTKPWDVVPMVTQMAMTDTTPFGQQRVFKEKVDTRTPRPMPGTRKVMEITAEWLWRTLGRNKRPRLCTREEFIKKVRTNAAMGAVFTEENQWDSARAAVEDEEFWKLVDRERELHKLGKCGSCVYNMMGKREKKLGEFGKAKGSRAIWYMWLGARYLEFEALGFLNEDHWFSRENSHSGVEGEGLHKLGYILRDISKIPGGAMYADDTAGWDTRITEDDLHNEEKITQQMDPEHRQLANAIFKLTYQNKVVKVQRPTPKGTVMDIISRKDQRGSGQVGTYGLNTFTNMEAQLIRQMEGEGVLSKADLENPHLLERKVTQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLRETACLGKAYAQMWALMYFHRRDLRLASNAICSAVPVHWVPTSRTTWSIHAHHQWMTTEDMLTVWNRVWIEDNPWMEDKTPVTTWEDVPYLGKREDQWCGSLIGLTSRATWAQNILTAIQQVRSLIGNEEFLDYMPSMKRFRKEEESEGAIW

SEQ ID NO: 5091 - protein, 3290 aa, Artificial Sequence
  derived and/or modified protein sequence (wt) from DENV-3__JQ920482__SS-prME
TSLCLMMMLPATLAFHLTSRDGEPRMIVGKNERGKSLLFKTASGINMCTLIAMDLGEMCDDTVTYKCPLITEVEPEDIDCWCNLTSTWVTYGTCNQAGEHRRDKRSVALAPHVGMGLDTRTQTWMSAEGAWRQVEKVETWAFRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNVTTDSRCPTQGEAILPEEQDQNYVCKHTYVDRGWGNGCGLFGKGSLVTCAKFQCLESIEGKAVQHENLKYTVIITVHTGDQHQVGNETQGVTAEITPQASTVEAILPEYGTLGLECSPRTGLDFNEMILLTMKNKAWMVHRQWFFDLPLPWTSGATTETPTWNKKELLVTFKNAHAKKQEVVVLGSQEGAMHTALTGATEIQTSGGTSIFAGHLKCRLKMDKLELKGMSYAMCLNAFVLKKEVSETQHGTILIKVEYKGEDAPCKIPFSTEDGQGKAHNGRLITANPIVTKKEEPVNIEAEPPFGESNIVIGIGDKALKINWYKKGSSIGKMFEATARGARRMAILGDTAWDFGSVGGVLNSLGKMVHQIFGSAYTALFSGVSWIMKIGIGVLLTWIGLNSKNTSMSFSCIVIGIITLYLGAVVQADMGCVINWKGKELKCGSGIFVTNEVHTWTEQYKFQADSPKRLATAIAGAWENGVCGIRSTTRMENLLWKQIANELNYILWENNIKLTIVVGDVIGVLEQGKRTLTPQPMELKYSWKTWGKAKIVTAETQNSSFIIDGPNTPECPSASRAWNVWEVEDYGFGVFTTNIWLKLREKYTQLCDHRLMSAAVKDERAVHADMGYWIESQKNGSWKLEKASLIEVKTCTWPKSHTLWSNGVLESDMIIPKSLAGPISQHNYRPGYHTQTAGPWHLGKLELDFNYCEGTTVVITENCGIRGPSLRTTTVSGKLIHEWCCRSCTLPPLRYMGEDGCWYGMEIRPINEKEENMVKSLVSAGSGKTDNFTMGVLCLAILFEEVMRGKFGKKHMIAGALFTFVLLLSGQITWRDMAHTLIMIGSNASDRMGMGVTYLALIATFKIQPFLALGFFLRKLTSRENLLLGVGLAMATTLQLPEDIEQMANGIALGLMALKLITQFETYQLWTALISLMCSNTIFTLTVAWRTATLILAVISLLPVCQSSSMRKTDWLPMTVAAMGVPPLPLFIFSLKDTLKRRSWPLNEGVMAVGLVSILASSFLRNDVPMAGPLVAGGLLIACYVITGTSADLTVEKAADVTWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTHNGKRLEPNWANVKKDLISYGGGWKLSAQWQKGEEVQVIAVEPGKNPKNFQTMPGIFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIVMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTVASAAQRRGRVGRNSQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGERNNQILEENMDVEIWTKEGEKKKLRPRWLDARTYSDPLALKEFKDFAAGRKSIALDLVTEIGRVPSHLAHRTRNALDNLVMLHTSEHGGRAYRHAVEELPETMETLLLLGLMILLTGGAMLFLISGKGIGKTSIGLICVVASSGMLWMADVPLQWIASAIVLEFFMMVLLIPEPEKQRTPQDNQLAYVVIGILTLAAIVAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLVTHYAIIGPGLQAKATREAQKRTAAGIMKNPTVDGIMTIDLDPVIYDSKFEKQLGQVMLLVLCAVQLLLMRTSWAFCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVSSVNMVSRLLLNRFTMTHRRPTIEKDVDLGAGTRHVNAEPETPNMDVIGERIRRIKEEHSSTWHYDDENPYKTWAYHGSYEVKATGSASSMINGVVKLLTKPWDVVPMVTQMAMTDTTPFGQQRVFKEKVDTRTPRPMPGTRKVMEITAEWLWRTLGRNKRPRLCTREEFIKKVRTNAAMGAVFTEENQWDSARAAVEDEEFWKLVDRERELHKLGKCGSCVYNMMGKREKKLGEFGKAKGSRAIWYMWLGARYLEFEALGFLNEDHWFSRENSHSGVEGEGLHKLGYILRDISKIPGGAMYADDTAGWDTRITEDDLHNEEKITQQMDPEHRQLANAIFKLTYQNKVVKVQRPTPKGTVMDIISRKDQRGSGQVGTYGLNTFTNMEAQLIRQMEGEGVLSKADLENPHLLEKKVTQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLRETACLGKAYAQMWALMYFHRRDLRLASNAICSAVPVHWVPTSRTTWSIHAHHQWMTTEDMLTVWNRVWIEDNPWMEDKTPVTTWEDVPYLGKREDQWCGSLIGLTSRATWAQNILTAIQQVRSLIGNEEFLDYMPSMKRFRKEEESEGAIW

SEQ ID NO: 5092 - protein, 3290 aa, Artificial Sequence
  derived and/or modified protein sequence (wt) from DENV-3__JQ920484__SS-prME
TSLCLMMMLPATLAFHLTSRDGEPRMIVGKNERGKSLLFKTASGINMCTLIAMDLGEMCDDTVTYKCPLITEVEPEDIDCWCNLTSTWVTYGTCNQAGEHRRDKRSVALAPHVGMGLDTRTQTWMSAEGAWRQVEKVETWAFRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNVTTDSRCPTQGEAILPEEQDQNYVCKHTYVDRGWGNGCGLFGKGSLVTCAKFQCLESIEGKAVQHENLKYTVIITVHTGDQHQVGNETQGVTAEITPQASTVEAILPEYGTLGLECSPRTGLDFNEMILLTMKNKAWMVHRQWFFDLPLPWTSGATTETPTWNKKELLVTFKNAHAKKQEVVVLGSQEGAMHTALTGATEIQTSGGTSIFAGHLKCRLKMDKLELKGMSYAMCLNAFVLKKEVSETQHGTILIKVEYKGEDAPCKIPFSTEDGQGKAHNGRLITANPIVTKKEEPVNIEAEPPFGESNIVIGIGDKALKINWYKKGSSIGKMFEATARGARRMAILGDTAWDFGSVGGVLNSLGKMVHQIFGSAYTALFSGVSWIMKIGIGVLLTWIGLNSKNTSMSFSCIVIGIITLYLGAVVQADMGCVINWKGKELKCGSGIFVTNEVHTWTEQYKFQADSPKRLATAIAGAWENGVCGIRSTTRMENLLWKQIANELNYILWENNIKLTIVVGDAIGVLEQGKRTLTPQPMELKYSWKTWGKAKIVTAETQNSSFIIDGPNTPECPSASRAWNVWEVEDYGFGVFTTNIWLKLREKYTQLCDHRLMSAAVKDERAVHADMGYWIESQKNGSWKLEKASLIEVKTCTWPKSHTLWSNGVLESDMIIPKSLAGPISQHNYRPGYHTQTAGPWHLGKLELDFNYCEGTTVVITENCGIRGPSLRTTTVSGKLIHEWCCRSCTLPPLRYMGEDGCWYGMEIRPINEKEENMVKSLVSAGSGKTDNFTMGVLCLAILFEEVMRGKFGKKHMIAGALFTFVLLLSGQITWRDMAHTLIMIGSNASDRMGMGVTYLALIATFKIQPFLALGFFLRKLTSRENLLLGVGLAMATTLQLPEDIEQMANGIALGLMALKLITQFETYQLWTALISLMCSNTIFTLTVAWRTATLILAVISLLPVCQSSSMRKTDWLPMTVAAMGVPPLPLFIFSLKDTLKRRSWPLNEGVMAVGLVSILASSFLRNDVPMAGPLVAGGLLIACYVITGTSADLTVEKAADVTWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTYNGKRLEPNWANVKKDLISYGGGWKLSAQWQKGEEVQVIAVEPGKNPKNFQTMPGIFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIVMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTVASAAQRRGRVGRNSQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGERNNQILEENMDVEIWTKEGEKKKLRPRWLDARTYSDPLALKEFKDFAAGRKSIALDLVTEIGRVPSHLAHRTRNALDNLVMLHTSEHGGRAYRHAVEELPETMETLLLLGLMILLTGGAMLFLISGKGIGKTSIGLICVVASSGMLWMADVPLQWIASAIVLEFFMMVLLIPEPEKQRTPQDNQLAYVVIGILTLAAIVAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLVTHYAIIGPGLQAKATREAQKRTAAGIMKNPTVDGIMTIDLDPVIYDSKFEKQLGQVMLLVLCAVQLLLMRTSWAFCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVSSVNMVSRLLLNRFTMTHRRPTIEKDVDLGAGTRHVNAEPETPNMDVIGERIRRIKEEHSSTWHYDDENPYKTWAYHGSYEVKATGSASSMINGVVKLLTKPWDVVPMVTQMAMTDTTPFGQQRVFKEKVDTRTPRPMPGTRKVMEITAEWLWRTLGRNKRPRLCTREEFIKKVRTNAAMGAVFTEENQWDSARAAVEDEEFWKLVDRERELHKLGKCGSCVYNMMGKREKKLGEFGKAKGSRAIWYMWLGARYLEFEALGFLNEDHWFSRENSHSGVEGEGLHKLGYILRDISKIPGGAMYADDTAGWDTRITEDDLHNEEKITQQMDPEHRQLANAIFKLTYQNKVVKVQRPTPKGTVMDIISRKDQRGSGQVGTYGLNTFTNMEAQLIRQMEGEGVLSKADLENPHLLEKKVTQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLRETACLGKAYAQMWALMYFHRRDLRLASNAICSAVPVHWVPTSRTTWSIHAHHQWMTTEDMLTVWNRVWIEDNPWMEDKTPVTTWEDVPYLGKREDQWCGSLIGLTSRATWAQNILTAIQQVRSLIGNEEFLDYMPSMKRFRKEEESEGAIW

SEQ ID NO: 5093 - protein, 3290 aa, Artificial Sequence
  derived and/or modified protein sequence (wt) from DENV-3__JQ920486__SS-prME
TSLCLMMMLPATLAFHLTSRDGEPRMIVGKNERGKSLLFKTASGINMCTLIAMDLGEMCDDTVTYKCPLITEVEPEDIDCWCNLTSTWVTYGTCNQAGEHRRDKRSVALAPHVGMGLDTRTQTWMSAEGAWRQVEKVETWAFRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNVTTDSRCPTQGEAILPEEQDQNYVCKHTYVDRGWGNGCGLFGKGSLVTCAKFQCLESIEGKAVQHENLKYTVIITVHTGDQHQVGNETQGVTAEITPQASTVEAILPEYGTLGLECSPRTGLDFNEMILLTMKNKAWMVHRQWFFDLPLPWTSGATTETPTWNKKELLVTFKNAHAKKQEVVVLGSQEGAMHTALTGATEIQTSGGTSIFAGHLKCRLKMDKLELKGMSYAMCLNAFVLKKEVSETQHGTILIKVEYKGEDAPCKIPFSTEDGQGKAHNGRLITANPIVTKKEEPVNIEAEPPFGESNIVIGIGDKALKINWYKKGSSIGKMFEATARGARRMAILGDTAWDFGSVGGVLNSLGKMVHQIFGSAYTALFSGVSWIMKIGIGVLLTWIGLNSKNTSMSFSCIVIGIITLYLGAVVQADMGCVINWKGKELKCGSGIFVTNEVHTWTEQYKFQADSPKRLATAIAGAWENGVCGIRSTTRMENLLWKQIANELNYILWENNIKLTIVVGDAIGVLEQGKRTLTPQPMELKYSWKTWGKAKIVTAETQNSSFIIDGPNTPECPSASRAWNVWEVEDYGFGVFTTNIWLKLREKYTQLCDHRLMSAAVKDERAVHVDMGYWIESQKNGSWKLEKASLIEVKTCTWPKSHTLWSNGVLESDMIIPKSLAGPISQHNYRPGYHTQTAGPWHLGKLELDFNYCEGTTVVITENCGIRGPSLRTTTVSGKLIHEWCCRSCTLPPLRYMGEDGCWYGMEIRPINEKEENMVKSLVSAGSGKTDNFTMGVLCLAILFEEVMRGKFGKKHMIAGALFTFVLLLSGQITWRDMAHTLIMIGSNASDRMGMGVTYLALIATFKIQPFLALGFFLRKLTSRENLLLGVGLAMATTLQLPEDIEQMANGIALGLMALKLITQFETYQLWTALISLMCSNTIFTLTVAWRTATLILAVISLLPVCQSSSMRKTDWLPMTVAAMGVPPLPLFIFSLKDTLKRRSWPLNEGVMAVGLVSILASSFLRNDVPMAGPLVAGGLLIACYVITGTSADLTVEKAADVTWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTHNGKRLEPNWANVKKDLISYGGGWKLSAQWQKGEEVQVIAVEPGKNPKNFQTMPGIFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIVMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTVASAAQRRGRVGRNSQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGERNNQILEENMDVEIWTKEGEKKKLRPRWLDARTYSDPLALKEFKDFAAGRKSIALDLVTEIGRVPSHLAHRTRNALDNLVMLHTSEHGGRAYRHAVEELPETMETLLLLGLMILLTGGAMLFLISGKGIGKTSIGLICVVASSGMLWMADVPLQWIASAIVLEFFMMVLLIPEPEKQRTPQDNQLAYVVIGILTLAAIVAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLVTHYAIIGPGLQAKATREAQKRTAAGIMKNPTVDGIMTIDLDPVIYDSKFEKQLGQVMLLVLCAVQLLLMRTSWAFCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRIEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVSSVNMVSRLLLNRFTMTHRRPTIEKDVDLGAGTRHVNAEPETPNMDVIGERIRRIKEEHSSTWHYDDENPYKTWAYHGSYEVKATGSASSMINGVVKLLTKPWDVVPMVTQMAMTDTTPFGQQRVFKEKVDTRTPRPMPGTRKVMEITAEWLWRTLGRNKRPRLCTREEFIKKVRTNAAMGAVFTEENQWDSARAAVEDEEFWKLVDRERELHKLGKCGSCVYNMMGKREKKLGEFGKAKGSRAIWYMWLGARYLEFEALGFLNEDHWFSRENSHSGVEGEGLHKLGYILRDISKIPGGAMYADDTAGWDTRITEDDLHNEEKITQQMDPEHRQLANAIFKLTYQNKVVKVQRPTPKGTVMDIISRKDQRGSGQVGTYGLNTFTNMEAQLIRQMEGEGVLSKADLENPHLLEKKVTQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLRETACLGKAYAQMWALMYFHRRDLRLASNAICSAVPVHWVPTSRTTWSIHAHHQWMTTEDMLTVWNRVWIEDNPWMEDKTPVTTWEDVPYLGKREDQWCGSLIGLTSRATWAQNILTAIQQVRSLIGNEEFLDYMPSMKRFRKEEESEGAIW

SEQ ID NO: 5094 - protein, 3290 aa, Artificial Sequence
  derived and/or modified protein sequence (wt) from DENV-3__JQ920485__SS-prME
TSLCLMMMLPATLAFHLTSRDGEPRMIVGKNERGKSLLFKTASGINMCTLIAMDLGEMCDDTVTYKCPLITEVEPEDIDCWCNLTSTWVTYGTCNQAGEHRRDKRSVALAPHVGMGLDTRTQTWMSAEGAWRQVEKVETWAFRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAILPEEQDQNYVCKHTYVDRGWGNGCGLFGKGSLVTCAKFQCLESIEGKAVQHENLKYTVIITVHTGDQHQVGNETQGVTAEITPQASTVEAILPEYGTLGLECSPRTGLDFNEMILLTMKNKAWMVHRQWFFDLPLPWTSGATTETPTWNKKELLVTFKNAHAKKQEVVVLGSQEGAMHTALTGATEIQTSGGTSIFAGHLKCRLKMDKLELKGMSYAMCLNAFVLKKEVSETQHGTILIKVEYKGEDAPCKIPFSTEDGQGKAHNGRLITANPIVTKKEEPVNIEAEPPFGESNIVIGIGDKALKINWYKKGSSIGKMFEATARGARRMAILGDTAWDFGSVGGVLNSLGKMVHQIFGSAYTALFSGVSWIMKIGIGVLLTWIGLNSKNTSMSFSCIVIGIITLYLGAVVQADMGCVINWKGKELKCGSGIFVTNEVHTWTEQYKFQADSPKRLATAIAGAWENGVCGIRSTTRMENLLWKQIANELNYILWENNIKLTIVVGDVIGVLEQGKRTLTPQPMELKYSWKTWGKAKIVTAETQNSSFIIDGPNTPECPSASRAWNVWEVEDYGFGVFTTNIWLKLREKHTQLCDHRLMSAAVKDERAVHADMGYWIESQKNGSWKLEKASLIEVKTCTWPKSHTLWSNGVLESDMIIPKSLAGPISQHNYRPGYHTQTAGPWHLGKLELDFNYCEGTTVVITENCGIRGPSLRTTTVSGKLIHEWCCRSCTLPPLRYMGEDGCWYGMEIRPINEKEENMVKSLVSAGSGKTDNFTMGVLCLAILFEEVMRGKFGKKHMIAGALFTFVLLLSGQITWRDMAHTLIMIGSNASDRMGMGVTYLALIATFKIQPFLALGFFLRKLTSRENLLLGVGLAMATTLQLPEDIEQMANGIALGLMALKLITQFETYQLWTALISLMCSNTIFTLTVAWRTATLILAVISLLPVCQSSSMRKTDWLPMTVAAMGVPPLPLFIFSLKDTLKRRSWPLNEGVMAVGLVSILASSFLRNDVPMAGPLVAGGLLIACYVITGTSADLTVEKAADVTWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTHNGKRLEPNWANVKKDLISYGGGWKLSAQWQKGEEVQVIAVEPGKNPKNFQTMPGIFQTTTGEIGAIALDFKPGTSGSPIINREGKVVGLYGNGVVTKNGGYVSGIAQTNAEPDGPIPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIVMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTVASAAQRRGRVGRNSQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGERNNQILEENMDVEIWTKEGEKKKLRPRWLDARTYSDPLALKEFKDFAAGRKSIALDLVTEIGRVPSHLAHRTRNALDNLVMLHTSEHGGRAYRHAVEELPETMETLLLLGLMILLTGGAMLFLISGKGIGKTSIGLICVVASSGMLWMADVPLQWIASAIVLEFFMMVLLIPEPEKQRTPQDNQLAYVVIGILTLAAIVAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLVTHYAIIGPGLQAKATREAQKRTAAGIMKNPTVDGIMTIDLDPVIYDSKFEKQLGQVMLLVLCAVQLLLMRTSWAFCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRIEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVSSVNMVSRLLLNRFTMTHRRPTIEKDVDLGAGTRHVNAEPETPNMNVIGERIRRIKEEHSSTWHYDDENPYKTWAYHGSYEVKATGSASSMINGVVKLLTKPWDVVPMVTQMAMTDTTPFGQQRVFKEKVDTRTPRPMPGTRKVMEITAEWLWRTLGRNKRPRLCTREEFIKKVRTNAAMGAVFTEENQWDSARAAVEDEEFWKLVDRERELHKLGKCGSCVYNMMGKREKKLGEFGKAKGSRAIWYMWLGARYLEFEALGFLNEDHWFSRENSHSGVEGEGLHKLGYILRDISKIPGGAMYADDTAGWDTRITEDDLHNEEKITQQMDPEHRQLANAIFKLTYQNKVVKVQRPTPKGTVMDIISRKDQRGSGQVGTYGLNTFTNMEAQLIRQMEGEGVLSKADLENPHLLEKKVTQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLRETACLGKAYAQMWALMYFHRRDLRLASNAICSAVPVHWVPTSRTTWSIHAHHQWMTTEDMLTVWNRVWIEDNPWMEDKTPVTTWEDVPYLGKREDQWCGSLIGLTSRATWAQNILTAIQQVRSLIGNEEFLDYMPSMKRFRKEEEPEGAIW

SEQ ID NO: 5095 - protein, 3290 aa, Artificial Sequence
  derived and/or modified protein sequence (wt) from DENV-3__FJ644564__SS-prME
TSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAVLPEEQDQNYVCKHTYVDRGWGNGCGLFGKGSLVTCAKFQCLEPIEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDAPCKIPFSTEDGQGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDTIGVLEQGKRTLTPQPMELKYSWKTWGKAKIVTAETQNSSFIIDGPNTPECPSASRAWNVWEVEDYGFGVFTTNIWLKLREVYTQMCDHRLMSAAVKDERAVHADMGYWIESQKNGSWKLEKASLIEVKTCTWPKSHTLWSNGVLESDMIIPKSLAGPISQHNHRPGYHTQTAGPWHLENLELDFTYCEGTTVVITENCGTRGPSLRTTTVSGKLIHEWCCRSCTLPPLRYMGEDGCWYGMEIRPISEKEENMVKSLVSAGSGKVDNFTMGILCLAILFEEVMRGKFGKKHMIAGVFFTFVLLLSGQITWRDMAHTLIMIGSNASDRMGMGVTYLALIATFKIQPFLALGFFLRKLTSRENLLLGVGLAMATTLQLPEDIEQMANGIALGLMALKLITQFETYQLWTALISLTCSNTIFTLTVAWRTATLILAGVSLLPVCQSSSMRKTDWLPMTVAAMGVPPLPLFIFSLKDTLKRRSWPLNEGVMAVGLVSILASSLLRNDVPMAGPLVAGGLLIACYVITGTSADLTVEKAADVTWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGILGKTQVGVGVQKEGVFHTMWHVTRGAVLTHNGKRLEPNWASVKKDLISYGGGWRLSAQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMSATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKDFAAGRKSIALDLVTEIGRVPSHLAHRTRNALDNLVMLHTSEHGGRAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIITIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGETTHHAVSRGSAKLQWLVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPAVIEHLERLQRKHGGMLVRNPLSRNSTHEMYWISNGTGNIVSSVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRPMPGTRKVMEITAEWLWRTLGRNKRPRLCTREEFTKKVRTNAAMGAVFTEENQWDSAKAAVEDEEFWKLVDRERELHKLGKCGSCVYNMMGKREKKLGEFGKAKGSRAIWYMWLGSRYLEFEALGFLNEDHWFSRENSYSGVEGEGLHKLGYILRDISKIPGGAMYADDTAGWDTRITEDDLHNEEKITQQMDPEHRLLANAIFKLTYQNKVVKVQRPTPTGTVMDIISRKDQRGSGQVGTYGLNTFTNMEAQLVRQMEGEGVLSKADLENPHLPEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLRETACLGKAYAQMWSLMYFHRRDLRLASNAICSAVPVHWVPTSRTTWSIHAHHQWMTTEDMLTVWNRVWIEDNPWMEDKTPVTTWENVPYLGKREDQWCGSLIGLTSRATWAQNIPTAIQQVRSLIGNEEFLDYMPSMKRFRKEEESEGAIW

SEQ ID NO: 5096 - protein, 3290 aa, Artificial Sequence
  derived and/or modified protein sequence (wt) from DENV-3__HQ235027__SS-prME
TSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAVLPEEQDQNYVCKHTYVDRGWGNGCGLFGKGSLVTCAKFQCLEPIEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGAIEIQNSGGTSIFAGHLKCRLKMDKLELKGMSYAMCTKTFVLKKEVSETQHGTILIKVEYKGEDAPCKIPFSTEDGQGKAYNGRLITANPVVTKKDEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNISMSFSCIAIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDTIGVLEQGKRTLTPQPMELKYSWKTWGKAKIVTAETQNSSFIIDGPNTPECPSASRAWNVWEVEDYGFGVFTTNIWLKLREVYTQLCDHRLMSAAVKDERAVHADMGYWIESQKNGSWKLEKASLIEVKTCTWPKSHTLWSNGVLESDMIIPKSLAGPISQHNHRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGKVDNFTMGVLCLAILFEEVMRGKFGKKHMIAGVFFTFVLLLSGQITWRDMAHTLIMIGSNASDRMGMGVTYLALIATFKIQPFLALGFFLRKLTSRENLLLGVGLAMATTLQLPEDIEQMANGIALGLMALKLITQFETYQLWTALISLTCSNTMFTLTVAWRTATLILAGVSLLPVCQSSSMRKTDWLPMAVAAMGVPPLPLFIFSLKDTLKRRSWPLNEGVMAVGLVSILASSLLRNDVPMAGPLVAGGLLIACYVITGTSADLTVEKAADITWEEEAEQTGVSHNLMITVDDDGTMRIKDDETENILTVLLKTALLVVSGVFPYSIPATLLVWHTWQKQTQRSGVLWDVPSPPETQKAELEEGVYRIKQQGIFGKTQVGVGVQKEGVFHTMWHVTRGAVLTYNGKRLEPNWASVKKDLISYGGGWRLSAQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKDFAAGRKSIALDLVTEIGRVPSHLAHRTRNALDNLVMLHTSEHGGRAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKEFDRYKKSGITEVDRTEAKEGLKRGETTHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKILNPYMPTVIEHLERLQRKHGGMLVRNPLSRNSTHEMYWISNGTGNIVASVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRSMPGTRRVMGITAEWLWRTLGRNKKPRLCTREEFTKKVRTNAAMGAVFTEENQWDSAKAAVEDEDFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPTGTVMDIISRKDQRGSGQVGTYGLNTFTNMEAQLIRQMEGEGVLSKADLENPHLPEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLRETACLGKAYAQMWSLMYFHRRDLRLASNAICSAVPVHWVPTSRTTWSIHAHHQWMTTEDMLTVWNRVWIEDNPWMEDKTPVTTWEDVPYLGKREDQWCGSLIGLTSRATWAQNIPTAIQQVRSLIGNEEFLDYMPSMKRFRKEEESEGAIW

SEQ ID NO: 5097 - protein, 3290 aa, Artificial Sequence
  derived and/or modified protein sequence (wt) from DENV-3__JQ920476__SS-prME
TSLCLMMMLPATLAFHLTSRDGEPRMIVGKNERGKSLLFKTASGINMCTLIAMDLGEMCDDTVTYKCPLITEVEPEDIDCWCNLTSTWVTYGTCNQAGEHRRDKRSVALAPHVGMGLDTRTQTWMSAEGAWRQVEKVETWAFRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNVTTDSRCPTQGEAILPEEQDQNYVCKHTYVDRGWGNGCGLFGKGSLVTCAKFQCLESIEGKAVQHENLKYTVIITVHTGDQHQVGNETQGVTAEITPQASTVEAILPEYGTLGLECSPRTGLDFNEMILLTMKNKAWMVHRQWFFDLPLPWTSGATTETPTWNKKELLVTFKNAHAKKQEVVVLGSQEGAMHTALTGATEIQTSGGTSIFAGHLKCRLKMDKLELKGMSYAMCLNAFVLKKEVSETQHGTILIKVEYKGEDAPCKIPFSTEDGQGKAHNGRLITANPIVTKKEEPVNIEAEPPFGESNIVIGIGDKALKINWYKKGSSIGKMFEATARGARRMAILGDTAWDFGSVGGVLNSLGKMVHQIFGSAYTALFSGVSWIMKIGIGVLLTWIGLNSKNTSMSFSCIVIGIITLYLGAVVQADMGCVINWKGKELKCGSGIFVTNEVHTWTEQYKFQADSPKRLATAIAGAWENGVCGIRSTTRMENLLWKQIANELNYILWENNIKLTIVVGDVIGVLEQGKRTLTPQPMELKYSWKTWGKAKIVTAETQNSSFIIDGPNTPECPNASRAWNVWEVEDYGFGVFTTNIWLKLREMYTQLCDHRLMSAAVKDERAVHADMGYWIESQKNGSWKLEKASLIEVKTCTWPKSHTLWSNGVLESDMIIPKSLAGPISQHNYRPGYHTQTAGPWHLGKLELDFNYCEGTTVVITENCGTRGPSLRTTTVSGKLIHEWCCRSCTLPPLRYMGEDGCWYGMEIRPINEKEENMVKSLVSAGSGKADNFTMGVLCLAILFEEVMRGKFGKKHMIAGALFTFVLLLSGQITWRDMAHTLIMIGSNASDRMGMGVTYLALIATFKIQPFLALGFFLRKLTSRENLLLGVGLAMATTLQLPEDIEQMANGIALGLMALKLITQFETYQLWTALVSLMCSNTIFTLTVAWRTATLILAVISLLPVCQSSSMRKTDWLPMTVAAMGVPPLPLFIFSLKDTLKRRSWPLNEGVMAVGLVSILASSFLRNDVPMAGPLVAGGLLIACYVITGTSADLTVEKAADVTWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTHNGKRLEPNWANVKKDLISYGGGWKLSAQWQKGEEVQVIAVEPGKNPKNFQTMPGIFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIVMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTVASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGERNNQILEENMDVEIWTKEGEKKKLRPRWLDARTYSDPLALKEFKDFAAGRKSIALDLVTEIGRVPSHLAHRTRNALDNLVMLHTSEHGGRAYRHAVEELPETMETLLLLGLMILLTGGAMLFLISGKGIGKTSIGLICVVASSGMLWMADVPLQWIASAIVLEFFMMVLLIPEPEKQRTPQDNQLAYVVIGILTLAAIVAANEMGLLETTKRDLGMSKESGVVSPTSYLDVDLHPASAWTLYAVATTVITPMLRHTIENSTANVSLAAIANQAVVLMGLDKGWPISKMDLGVPLLALGCYSQVNPLTLTAAVLLLVTHYAIIGPGLQAKATREAQKRTAAGIMKNPTVDGIMTIDLDPVIYDSKFEKQLGQVMLLVLCAVQLLLMRTSWAFCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVSSVNMVSRLLLNRFTMTHRRPTIEKDVDLGAGTRHVNAEPETPNMDVIGERIRRIKEEHSSTWHYDDENPYKTWAYHGSYEVKATGSASSMINGVVKLLTKPWDVVPMVTQMAMTDTTPFGQQRVFKEKVDTRTPRPMPGTRKVMEITAEWLWRTLGRNKRPRLCTREEFIKKVRTNAAMGAVFTEENQWDSARAAVEDEEFWKLVDRERELHKLGKCGSCVYNMMGKREKKLGEFGKAKGSRAIWYMWLGARYLEFEALGFLNEDHWFSRENSHSGVEGEGLHKLGYILRDISKIPGGAMYADDTAGWDTRITEDDLHNEEKITQQMDPEHRQLANAIFKLTYQNKVVKVQRPTPKGTVMDIISRKDQRGSGQVGTYGLNTFTNMEAQLIRQMEGEGVLSKADLENPHLLEKKVTQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLRETACLGKAYAQMWALMYFHRRDLRLASNAICSAVPVHWVPTSRTTWSIHAHHQWMTTEDMLTVWNRVWIEDNPWMEDKTPVTTWEDVPYLGKREDQWCGSLIGLTSRATWAQNILTAIQQVRSLIGNEEFLDYMPSMKRFRKEEESEGAIW

SEQ ID NO: 5098 - protein, 3290 aa, Artificial Sequence
  derived and/or modified protein sequence (wt) from DENV-3__JQ920477__SS-prME
TSLCLMMMLPATLAFHLTSRDGEPRMIVGKNERGKSLLFKTASGINMCTLIAMDLGEMCDDTVTYKCPLITEVEPEDIDCWCNLTSTWVTYGTCNQAGEHRRDKRSVALAPHVGMGLDTRTQTWMSAEGAWRQVEKVETWAFRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNVTTDSRCPTQGEAILPEEQDQNYVCKHTYVDRGWGNGCGLFGKGSLVTCAKFQCLESIEGKAVQHENLKYTVIITVHTGDQHQVGNETQGVTAEITPQASTVEAILPEYGTLGLECSPRTGLDFNEMILLTMKNKAWMVHRQWFFDLPLPWTSGATTETPTWNKKELLVTFKNAHAKKQEVVVLGSQEGAMHTALTGATEIQTSGGTSIFAGHLKCRLKMDKLELKGMSYAMCLNAFVLKKEVSETQHGTILIKVEYKGEDAPCKIPFSTEDGQGKAHNGRLITANPIVTKKEEPVNIEAEPPFGESNIVIGIGDKALKINWYKKGSSIGKMFEATARGARRMAILGDTAWDFGSVGGVLNSLGKMVHQIFGSAYTALFSGVSWIMKIGIGVLLTWIGLNSKNTSMSFSCIVIGIITLYLGAVVQADMGCVINWKGKELKCGSGIFVTNEVHTWTEQYKFQADSPKRLATAIAGAWENGVCGIRSTTRMENLLWKQIANELNYILWENNIKLTIVVGDVIGVLEQGKRTLTPQPMELKYSWKTWGKAKIVTAETQNSSFIIDGPNTPECPSALRAWNVWEVEDYGFGVFTTNIWLKLREKYTQLCDHRLMSAAVKDERAVHADMGYWIESQKNGSWKLEKASLIEVKTCTWPKSHTLWSNGVLESDMIIPKSLAGPISQHNYRPGYHTQTAGPWHLGKLELDFNYCEGTTVVITENCGTRGPSLRTTTVSGKLIHEWCCRSCTLPPLRYMGEDGCWYGMEIRPINEKEENMVKSLVSAGSGKTDNFTMGVLCLAILFEEVMRGKFGKKHMIAGALFTFVLLLSGQITWRDMAHTLIMIGSNASDRMGMGVTYLALIATFKIQPFLALGFFLRKLTSRENLLLGVGLAMATTLQLPEDIEQMANGIALGLMALKLITQFETYQLWTALVSLMCSNTIFTLTVAWRTATLILAVISLLPVCQSSSMRKTDWLPMTVAAMGVPPLPLFIFSLKDTLKRRSWPLNEGVMAVGLVSILASSFLRNDVPMAGPLVAGGLLIACYVITGTSADLTVEKAADVTWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTHNGKRLEPNWANVKKDLISYGGGWKLSAQWQKGEEVQVIAVEPGKNPKNFQTMPGIFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIVMDEAHFTDPASIAARGYISTRVGMGEAAAISMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTVASAAQRRGRVGRNSQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGERNNQILEENMDVEIWTKEGEKKKLRPRWLDARTYSDPLALKEFKDFAAGRKSIALDLVTEIGRVPSHLAHRTRNALDNLVMLHTSEHGGRAYRHAVEELPETMETLLLLGLMILLTGGAMLFLISGKGIGKTSIGLICVVASSGMLWMADVPLQWIASAIVLEFFMMVLLIPEPEKQRTPQDNQLAYVVIGILTLAAIVAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLVTHYAIIGPGLQAKATREAQKRTAAGIMKNPTVDGIMTIDLDPVIYDSKFEKQLGQVMLLVLCAVQLLLMRTSWAFCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVSSVNMVSRLLLNRFTMTHRRPTIEKDVDLGAGTRHVNAEPETPNMDVIGERIRRIKEEHSSTWHYDDENPYKTWAYHGSYEVKATGSASSMINGVVKLLTKPWDVVPMVTQMAMTDTTPFGQQRVFKEKVDTRTPRPMPGTRKVMEITAEWLWRTLGRNKRPRLCTREEFIKKVRTNAAMGAVFTEENQWDSARAAVEDEEFWKLVDRERELHKLGKCGSCVYNMMGKREKKLGEFGKAKGSRAIWYMWLGARYLEFEALGFLNEDHWFSRENSHSGVEGEGLHKLGYILRDISKIPGGAMYADDTAGWDTRITEDDLHNEEKITQQMDPEHRQLANAIFKLTYQNKVVKVQRPTPKGTVMDIISRKDQRGSGQVGTYGLNTFTNMEAQLIRQMEGEGVLSKADLENPHLLEKKVTQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLRETACLGKAYAQMWALMYFHRRDLRLASNAICSAVPVHWVPTSRTTWSIHAHHQWMTTEDMLTVWNRVWIEDNPWMEDKTPVTTWEDVPYLGKREDQWCGSLIGLTSRATWAQNILTAIQQVRSLIGNEEFLDYMPSMKRFRKEEESEGAIW

SEQ ID NO: 5099 - protein, 3290 aa, Artificial Sequence
  derived and/or modified protein sequence (wt) from DENV-3__JQ920478__SS-prME
TSLCLMMMLPATLAFHLTSRDGEPRMIVGKNERGKSLLFKTASGINMCTLIAMDLGEMCDDTVTYKCPLITEVEPEDIDCWCNLTSTWVTYGTCNQAGEHRRDKRSVALAPHVGMGLDTRTQTWMSAEGAWRQVEKVETWAFRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNVTTDSRCPTQGEAILPEEQDQNYVCKHTYVDRGWGNGCGLFGKGSLVTCAKFQCLESIEGKAVQHENLKYTVIITVHTGDQHQVGNETQGVTAEITPQASTVEAILPEYGTLGLECSPRTGLDFNEMILLTMKNKAWMVHRQWFFDLPLPWTSGATTETPTWNKKELLVTFKNAHAKKQEVVVLGSQEGAMHTALTGATEIQTSRGTSIFAGHLKCRLKMDKLELKGMSYAMCLNAFVLKKEVSETQHGTILIKVEYKGEDAPCKIPFSTEDGQGKAHNGRLITANPIVTKKEEPVNIEAEPPFGESNIVIGIGDKALKINWYKKGSSIGKMFEATARGARRMAILGDTAWDFGSVGGVLNSLGKMVHQIFGSAYTALFSGVSWIMKIGIGVLLTWIGLNSKNTSMSFSCIVIGIITLYLGAVVQADMGCVINWKGKELKCGSGIFVTNEVHTWTEQYKFQADSPKRLATAIAGAWENGVCGIRSTTRMENLLWKQIANELNYILWENNIKLTIVVGDVIGVLEQGKRTLTPQPMELKYSWKTWGKAKIVTAETQNSSFIIDGPNTPECPSALRAWNVWEVEDYGFGVFTTNIWLKLREKYTQLCDHRLMSAAVKDERAVHADMGYWIESQKNGSWKLEKASLIEVKTCTWPKSHTLWSNGVLESDMIIPKSLAGPISQHNYRPGYHTQTAGPWHLGKLELDFNYCEGTTVVITENCGTRGPSLRTTTVSGKLIHEWCCRSCTLPPLRYMGEDGCWYGMEIRPINEKEENMVKSLVSAGSGKTDNFTMGVLCLAILFEEVMRGKFGKKHMIAGALFTFVLLLSGQITWRDMAHTLIMIGSNASDRMGMGVTYLALIATFKIQPFLALGFFLRKLTSRENLLLGVGLAMATTLQLPEDIEQMANGIALGLMALKLITQFETYQLWTALISLMCSNTIFTLTVAWRTATLILAVISLLPVCQSSSMRKTDWLPMTVAAMGVPPLPLFIFSLKDTLKRRSWPLNEGVMAVGLVSILASSFLRNDVPMAGPLVAGGLLIACYVITGTSADLTVEKAADVTWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTHNGKRLEPNWANVKKDLISYGGGWKLSAQWQKGEEVQVIAVEPGKNPKNFQTMPGIFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIVMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTVASAAQRRGRVGRNSQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGERNNQILEENMDVEIWTKEGEKKKLRPRWLDARTYSDPLALKEFKDFAAGRKSIALDLVTEIGRVPSHLAHRTRNALDNLVMLHTSEHGGRAYRHAVEELPETMETLLLLGLMILLTGGAMLFLISGKGIGKTSIGLICVVASSGMLWMADVPLQWIASAIVLEFFMMVLLIPEPEKQRTPQDNQLAYVVIGILTLAAIVAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLVTHYAIIGPGLQAKATREAQKRTAAGIMKNPTVDGIMTIDLDPVIYDSKFEKQLGQVMLLVLCAVQLLLMRTSWAFCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVSSVNMVSRLLLNRFTMTHRRPTIEKDVDLGAGTRHVNAEPETPNMDVIGERIRRIKEEHSSTWHYDDENPYKTWAYHGSYEVKATGSASSMINGVVKLLTKPWDLVPMVTQMAMTDTTPFGQQRVFKEKVDTRTPRPMPGTRKVMEITAEWLWRTLGRNKRPRLCTREEFIKKVRTNAAMGAVFTEENQWDSARAAVEDEEFWKLVDRERELHKLGKCGSCVYNMMGKREKKLGEFGKAKGSRAIWYMWLGARYLEFEALGFLNEDHWFSRENSHSGVEGEGLHKLGYILRDISKIPGGAMYADDTAGWDTRITEDDLHNEEKITQQMDPEHRQLANAIFKLTYQNKVVKVQRPTPKGTVMDIISRKDQRGSGQVGTYGLNTFTNMEAQLIRQMEGEGVLSKADLENPHLLEKKVTQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLRETACLGKAYAQMWALMYFHRRDLRLASNAICSAVPVHWVPTSRTTWSIHAHHQWMTTEDMLTVWNRVWIEDNPWMEDKTPVTTWEDVPYLGKREDQWCGSLIGLTSRATWAQNILTAIQQVRSLIGNEEFLDYMPSMKRFRKEEESEGAIW

SEQ ID NO: 5100 - protein, 3290 aa, Artificial Sequence
  derived and/or modified protein sequence (wt) from DENV-3__JQ920480__SS-prME
TSLCLMMMLPATLAFHLTSRDGEPRMIVGKNERGKSLLFKTASGINMCTLIAMDLGEMCDDTVTYKCPLITEVEPEDIDCWCNLTSTWVTYGTCNQAGEHRRDKRSVALAPHVGMGLDTRTQTWMSAEGAWRQVEKVETWAFRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNVTTDSRCPTQGEAILPEEQDQNYVCKHTYVDRGWGNGCGLFGKGSLVTCAKFQCLESIEGKAVQHENLKYTVIITVHTGDQHQVGNETQGVTAEITPQASTVEAILPDYGTLGLECSPRTGLDFNEMILLTMKNKAWMVHRQWFLDLPLPWTSGATTETPTWNKKELLVTFKNAHAKKQEVVVLGSQEGAMHTALTGATEIQTSGGTSIFAGHLKCRLKMDKLELKGMSYAMCLNAFVLKKEVSETQHGTILIKVEYKGEDAPCKIPFSTEDGQGKAHNGRLITANPIVTKKEEPVNIEAEPPFGESNIVIGIGDKALKINWYKKGSSIGKMFEATARGARRMAILGDTAWDFGSVGGVLNSLGKMVHQIFGSAYTALFSGVSWIMKIGIGVLLTWIGLNSKNTSMSFSCIVIGIITLYLGAVVQADMGCVINWKGKELKCGSGIFVTNEVHTWTEQYKFQADSPKRLATAIAGAWENGVCGIRSTTRMENLLWKQIANELNYILWENNIKLTIVVGDVIGVLEQGKRTLTPQPMELKYSWKTWGKAKIVTAETQNSSFIIDGPNTPECPSALRAWNVWEVEDYGFGVFTTNIWLKLREKYTQLCDHRLMSAAVKDERAVHADMGYWIESQKNESWKLEKASLIEVKTCTWPKSHTLWSNGVLESDMIIPKSLAGPISQHNYRPGYHTQTAGPWHLGKLELDFNYCEGTTVVITENCGTRGPSLRTTTVSGKLIHEWCCRSCTLPPLRYMGEDGCWYGMEIRPINEKEENMVKSLVSAGSGKTDNFTMGVLCLAILFEEVMRGKFGKKHMIAGALFMFVLLLSGQITWRDMVHTLIMIGSNASDRMGMGVTYLALIATFKIQPFLALGFFLRKLTSRENLLLGVGLAMATTLQLPEDIEQMANGIALGLMALKLITQFETYQLWTALISLMCSNTIFTLTVAWRTATLILAVISLLPVCQSSSMRKTDWLPMTVAAMGVPPLPLFIFSLKDTLKRRSWPLNEGVMAVGLVSILASSFLRNDVPMAGPLVAGGLLIACYVITGTSADLTVEKAADVTWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTHNGKRLEPNWANVKKDLISYGGGWKLSAQWQKGEEVQVIAVEPGKNPKNFQTMPGIFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIVMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTVASAAQRRGRVGRNSQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGERNNQILEENMDVEIWTKEGEKKKLRPRWLDARTYSDPLALKEFKDFAAGRKSIALDLVTEIGRVPSHLAHRTRNALDNLVMLHTSEHGGRAYRHAVEELPETMETLLLLGLMILLTGGAMLFLISGKGIGKTSIGLICVVASSGMLWMADVPLQWIASAIVLEFFMMVLLIPEPEKQRTPQDNQLAYVVIGILTLAAIVAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLVTHYAIIGPGLQAKATREAQKRTAAGIMKNPTVDGIMTIDLDPVIYDSKFEKQLGQVMLLVLCAVQLLLMRTSWAFCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVSSVNMVSRLLLNRFTMTHRRPTIEKDVDLGAGTRHVNAEPETPNMDVIGERIRRIKEEHSSTWHYDDENPYKTWAYHGSYEVKATGSASSMINGVVKLLTKPWDVVPMVTQMAMTDTTPFGQQRVFKEKVDTRTPRPMPGTRKVMEITAEWLWRTLGRNKRPRLCTREEFIKKVRTNAAMGAVFTEENQWDSARAAVEDEEFWKLVDRERELHKLGKCGSCVYNMMGKREKKLGEFGKAKGSRAIWYMWLGARYLEFEALGFLNEDHWFSRENSHSGVEGEGLHKLGYILRDISKIPGGAMYADDTAGWDTRITEDDLHNEEKITQQMDPEHRQLANAIFKLTYQNKVVKVQRPTPKGTVMDIISRKDQRGSGQVGTYGLNTFTNMEAQLIRQMEGEGVLSKADLENPHLLEKKVTQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLRETACLGKAYAQMWALMYFHRRDLRLASNAICSAVPVHWVPTSRTTWSIHAHHQWMTTEDMLTVWNRVWIEDNPWMEDKTPVTTWEDVPYLGKREDQWCGSLIGLTSRATWAQNILTAIQQVRSLIGNEEFLDYMPSMKRFRKEEESEGAIW

SEQ ID NO: 5101 - protein, 3290 aa, Artificial Sequence
  derived and/or modified protein sequence (wt) from DENV-3__JQ920479__SS-prME
TSLCLMMMLPATLAFHLTSRDGEPRMIVGKNERGKSLLFKTASGINMCTLIAMDLGEMCDDTVTYKCPLITEVEPEDIDCWCNLTSTWVTYGTCNQAGEHRRDKRSVALAPHVGMGLDTRTQTWMSAEGAWRQVEKVETWAFRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNVTTDSRCPTQGEAILPEEQDQNYVCKHTYVDRGWGNGCGLFGKGSLVTCAKFQCLESIEGKAVQHENLKYTVIITVHTGDQHQVGNETQGVTAEITPQASTVEAILPEYGTLGLECSPRTGLDFNEMILLTMKNKAWMVHRQWFLDLPLPWTSGATTETPTWNKKELLVTFKNAHAKKQEVVVLGSQEGAMHTALTGATEIQTSGGTSIFAGHLKCRLKMDKLELKGMSYAMCLNAFVLKKEVSETQHGTILIKVEYKGEDAPCKIPFSTEDGQGKAHNGRLITANPIVTKKEEPVNIEAEPPFGESNIVIGIGDKALKINWYKKGSSIGKMFEATARGARRMAILGDTAWDFGSVGGVLNSLGKMVHQIFGSAYTALFSGVSWIMKIGIGVLLTWIGLNSKNTSMSFSCIVIGIITLYLGAVVQADMGCVINWKGKELKCGSGIFVTNEVHTWTEQYKFQADSPKRLATAIAGAWENGVCGIRSTTRMENLLWKQIANELNYILWENNIKLTIVVGDVIGVLEQGKRTLTPQPMELKYSWKTWGKAKIVTAETQNSSFIIDGPNTPECPSALRAWNVWEVEDYGFGVFTTNIWLKLREKYTQLCDHRLMSAAVKDERAVHADMGYWIESQKNESWKLEKASLIEVKTCTWPKSHTLWSNGVLESDMIIPKSLAGPISQHNYRPGYHTQTAGPWHLGKLELDFNYCEGTTVVITENCGIRGPSLRTTTVSGKLIHEWCCRSCTLPPLRYMGEDGCWYGMEIRPINEKEENMVKSLVSAGSGKTDNFTMGVLCLAILFEEVMRGKFGKKHMIAGALFMFVLLLSGQITWRDMVHTLIMIGSNASDRMGMGVTYLALIATFKIQPFLALGFFLRKLTSRENLLLGVGLAMATTLQLPEDIEQMANGIALGLMALKLITQFETYQLWTALISLMCSNTIFTLTVAWRTATLILAVISLLPVCQSSSMRKTDWLPMTVAAMGVPPLPLFIFSLKDTLKRRSWPLNEGVMAVGLVSILASSFLRNDVPMAGPLVAGGLLIACYVITGTSADLTVEKAADVTWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTHNGKRLEPNWANVKKDLISYGGGWKLSAQWQKGEEVQVIAVEPGKNPKNFQTMPGIFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIVMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTVASAAQRRGRVGRNSQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGERNNQILEENMDVEIWTKEGEKKKLRPRWLDARTYSDPLALKEFKDFAAGRKSIALDLVTEIGRVPSHLAHRTRNALDNLVMLHTSEHGGRAYRHAVEELPETMETLLLLGLMILLTGGAMLFLISGKGIGKTSIGLICVVASSGMLWMADVPLQWIASAIVLEFFMMVLLIPEPEKQRTPQDNQLAYVVIGILTLAAIVAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLVTHYAIIGPGLQAKATREAQKRTAAGIMKNPTVDGIMTIDLDPVIYDSKFEKQLGQVMLLVLCAVQLLLMRTSWAFCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGEITHHAVSRGSAKLQWFVERNMVIPEGRVIDLGCGRGGWSYYSAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVSSVNMVSRLLLNRFTMTHRRPTIEKDVDLGAGTRHVNAEPETPNMDVIGERIRRIKEEHSSTWHYDDENPYKTWAYHGSYEVKATGSASSMINGVVKLLTKPWDVVPMVTQMAMTDTTPFGQQRVFKEKVDTRTPRPMPGTRKVMEITAEWLWRTLGRNKRPRLCTREEFIKKVRTNAAMGAVFTEENQWDSARAAVEDEEFWKLVDRERELHKLGKCGSCVYNMMGKREKKLGEFGKAKGSRAIWYMWLGARYLEFEALGFLNEDHWFSRENSHSGVEGEGLHKLGYILRDISKIPGGAMYADDTAGWDTRITEDDLHNEEKITQQMDPEHRQLANAIFKLTYQNKVVKVQRPTPKGTVMDIISRKDQRGSGQVGTYGLNTFTNMEAQLIRQMEGEGVLSKADLENPHLLEKKVTQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLRETACLGKAYAQMWALMYFHRRDLRLASNAICSAVPVHWVPTSRTTWSIHAHHQWMTTEDMLTVWNRVWIEDNPWMEDKTPVTTWEDVPYLGKREDQWCGSLIGLTSRATWAQNILTAIQQVRSLIGNEEFLDYMPSMKRFRKEEESEGAIW

SEQ ID NO: 5102 - protein, 3290 aa, Artificial Sequence
  derived and/or modified protein sequence (wt) from DENV-3__KU216208__SS-prME
TSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWIDVVLEHGGCVTTMAKNKPTLDIELQKTEATQLATLRKLCIEGKITNITTDSRCPTQGEAVLPEEQDQNYVCKHAYVDRGWGNGCGLFGKGSLVTCAKFQCLEPIEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDAPCKIPFSTEDGQGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQADMGCVVNWKGKELKCGSGIFVTNEVHTWTEQYKFQADSPKRLATAIAGAWENGVCGIRSTTRMENLLWKQIANELNYILWENNIKLTVVVGDTIGVLEQGKRTLTPQPMELKYSWKTWGKAKIVTAETQNSSFIIDGPNTPECPSASRAWNVWEVEDYGFGVFTTNIWLKLREVYTQMCDHRLMSAAVKDERAVHADMGYWIESQKNGSWKLEKASLIEVKTCTWPKSHTLWSNGVLESDMIIPKSLAGPISQHNYRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGKVDNFTMGVLCLAILFEEVMRGKFGKKHMIAGVFFTFVLLLSGQITWRDMAHTLIMIGSNASDRMGMGVTYLALIATFKIQPFLALGFFLRKLTSRENLLLGVGLAMATTLQLPEDIEQMANGIALGLMALKLITQFETYQLWTALISLTCSNTIFTLTVAWRTATLILAGVSLLPVCQSSSMRKTDWLPMTVAAMGVPPLPLFIFSLKDTLKRRSWPLNEGVMAVGLVSILASSLLRNDVPMAGPLVAGGLLIACYVITGTSADLTVEKAADVTWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGILGKTQVGVGVQKEGVFHTMWHVTRGAVLTHNGKRLEPNWASVKKDLISYGGGWRLSAQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFETEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAYKVASEGIKYTDRKWCFDGQRNNQILEENMDVEIWTKEGEKKKLRPRWLDARTYSDPLALKEFKDFAAGRKSIALDLVTEIGRVPSHLAHRTRNALDNLVMLHTSEHGGRAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIITIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGETTHHAVSRGSAKLQWFVERNMVIPEGRVIDLGCGRGGWSYYCAGLKKVTEVRGYTKGGPGHEEPVPMATYGWNIVKLMSGKDVFYLPPEKCDTLLCDIGESSPSPTVEESRTIRVLKMVEPWLKNNQFCIKVLNPYMPAVIEHLERLQRKHGGMLVRNPLSRNSTHEMYWISNGTGNIVSSVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRPMPGTRKVMEITAEWLWRTLGRNKRPRLCTREEFTKKVRTNAAMGAVFTEENQWDSAKAAVEDEEFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRLLANAIFKLTYQNKVVKVQRPTPTGTVMDIISRKDQRGSGQVGTYGLNTFTNMEAQLVRQMEGEGVLSKADLENPHLPEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLRETACLGKAYAQMWSLMYFHRRDLRLASNAICSAVPVHWVPTSRTTWSIHAHHQWMTTEDMLTVWNRVWIEDNPWMEDKTPVTTWENVPYLGKREDQWCGSLIGLTSRATWAQNIPTAIQQVRSLIGNEEFLDYMPSMKRFRKEEESEGAIW

SEQ ID NO: 5103 - protein, 3290 aa, Artificial Sequence
  derived and/or modified protein sequence (wt) from DENV-3__GU370053__SS-prME
TSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAVLPEEQDQNYVCKHTYVDRGWGNGCGLFGKGSLVTCAKFQCLEPIEGKVVQYENLKYTVIITVHTGDQHQVGNETQGVTAEITPQASTTEAILPEYGTLGLECSPRTGLDFNEMILLTMKNKAWMVHRQWFFDLPLPWASGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDAPCKIPFSTEDGQGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDTIGVLEQGKRTLTPQPMELKYSWKTWGKAKIVTAEIQNSSFIIDGPNTPECPSASRAWNVWEVEDYGFGVFTTNIWLKLREVYTQLCDHRLMSAAVKDERAVHADMGYWIESQKNGSWKLEKASLIEVKTCTWPKSHTLWSNGVLESDMIIPKSLAGPISQHNYRPGYHTQTAGPWHLGKLELDFNYCEGTTVVITESCGTRGPSLRTTTVSGKLIHEWCCRSCTLPPLRYMGEDGCWYGMEIRPISEKEENMVKSLVSAGSGKVDNFTMGVLCLAILYEEVMRGKFGKKHMIAGVFFTFVLLLSGQITWRDMAHTLIMIGSNASDRMGMGVTYLALIATFKIQPFLALGFFLRKLTSRENLLLGVGLAMATTLQLPEDIEQMANGIALGLMALKLITQFETYQLWTALVSLTCSNTIFTLTVAWRTATLILAGVSLLPVCQSSSMRKTDWLPMAVAAMGVPPLPLFIFSLKDTLKRRSWPLNEGVMAVGLVSILASSLLRNDVPMAGPLVAGGLLIACYVITGTSADLTVEKAADVTWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTHNGKRLEPNWASVKKDLISYGGGWRLSAQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIVMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKDFAAGRKSIALDLVTEIGRVPSHLAHRTRNALDNLVMLHTSEHGGRAYRHAVEELPETMETLLLLGLMILLTGGAMLFLISGKGIGKTSIGLICVIASSGMLWMAEVPLQWIASAIVLEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGETTHHAVSRGSAKLQWFVERNMVVPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVSSVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRPMPGTRKVMEITAEWLWRTLGRNKRPRLCTREEFTKKVRTNAAMGAVFTEENQWDSAKAAVEDEEFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKIIQQMDPEHRQLANAIFKLTYQNKVVKVQRPTPTGTVMDIISRKDQRGSGQVGTYGLNTFTNMEAQLVRQMEGEGVLTKADLENPHLPEKKITQWLETKGVERLKRMAISGDDCVVKPIDDRFANALLALNDMGKVRKDIPQWQPSRGWHDWQQVPFCSHHFHELIMKDGRKLVVPCRPQDELIGRARISQGAGWSLRETACLGKAYAQMWSLMYFHRRDLRLASNAICSAVPVHWVPTSRTTWSIHAHHQWMTTEDMLTVWNRVWIEENPWMEDKTPVTTWENVPYLGKREDQWCGSLIGLTSRATWAQNILTAIQQVRSLIGNEEFLDYMPSMKRFRKEEESEGAIW

SEQ ID NO: 5104 - protein, 3290 aa, Artificial Sequence
  derived and/or modified protein sequence (wt) from DENV-3__JQ411814__SS-prME
TSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGIGNRDFVEGLSGATWVDVVLEHGGCVTTMAKNKPTLDIELQKTEATQLATLRKLCIEGKITNITTDSRCPTQGEAVLPEEQDQNYVCKHTYVDRGWGNGCGLFGKGSLVTCAKFQCLEPIEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDAPCKIPFSTEDGQGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDTIGVLEQGKRTLTPQPMELKYSWKTWGKAKIVTAETQNSSFIIDGPNTPECPSASRAWNVWEVEDYGFGVFTTNIWLKLRDVYTQLCDHRLMSAAVKDERAVHADMGYWIESQKNGSWKLEKASLIEVKTCTWPKSHTLWSNGVLESDMIIPKSLAGPISQHNYRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGKVDNFTMGVLCLAILFEEVMRGKFGKKHMIAGVLFTFVLLLSGQITWRDMAHTLIMIGSNASDRMGMGVTYLALIATFKIQPFLALGFFLRKLTSRENLLLGVGLAMATTLQLPEDIEQMANGIALGLMALKLITQFETYQLWTALVSLTCSNTILTLTVAWRTATLILAGVSLLPVCQSSSMRKTDWLPMTVAAMGVPPLPLFIFSLKDTLKRRSWPLNEGVMAVGLVSILASSLLRNDVPMAGPLVAGGLLIACYVITGTSADLTVEKAADVTWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGILGKTQVGVGVQKEGVFHTMWHVTRGAVLTHNGKRLEPNWASVKKDLISYGGGWRLSAQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKDFAAGRKSIALDLVTEIGRVPSHLAHRTRNALDNLVMLHTSEHGGRAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVSSVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRPMPGTRKVMGITAEWLWRTLGRNKRPRLCTREEFTKKVRTNAAMGAVFTEENQWDSAKAAVEDEEFWKLVDRERELHKLGKCGSCVYNMMGKREKKLGEFGKAKGSRAIWYMWLGARYLEFEALGFLNEDHWFSRDNSYSGVEGEGLHKLGYILRDISKIPGGAMYADDTAGWDTRITEDDLHNEEKITQQMDPEHRQLANAIFKLTYQNKVVKVQRPTPTGTVMDIISRKDQRGSGQVGTYGLNTFTNMEVQLVRQMEGEGVLSKADLENPHLPEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLRETACLGKAYAQMWSLMYFHRRDLRLASNAICSAVPVHWVPTSRTTWSIHAHHQWMTTEDMLTVWNRVWIEDNPWMEDKTPVTTWENVPYLGKREDQWCGSLIGLTSRATWAQNIPTAIQQVRSLIGNEEFLDYMPSMKRFRKEEESEGAIW

SEQ ID NO: 5105 - protein, 3290 aa, Artificial Sequence
  derived and/or modified protein sequence (wt) from DENV-3__KM190937__SS-prME
TSLCLMMMLPATLAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVAIAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAILPEEQDQNYVCKHTYVDRGWGNGCGLFGKGSLVTCAKFQCLESIEGKVVQHENLKYTVIITVHTGDQHQVGNEMQGVTAEITPQASTAEVILPEYGTLGLECSPRTGLDFNEMISLTMKNKAWMVHRQWFFDLPLPWTSGATAETPTWNRKELLVTFKNAHAKKQEVVVLGSQEGAMHTALTGATEIQTSGGTSIFAGHLKCRLKMDKLELKGMSYAMCLSSFVLKKEVSETQHGTILIKVEYKGEDAPCKIPFSTEDGQGKAHNGRLITANPVVTKKEEPVNIEAEPPFGESNIVIGIGDKALKINWYKKGSSIGKMFEATARGARRMAILGDTAWDFGSVGGVLNSLGKMVHQIFGSAYTALFGGVSWMMKIGIGVLLTWIGLNSKNTSMSFSCIAIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDITGVLEQGKRTLTPQPMELKYSWKTWGKAKIVTAETQNSSFIIDGPSTPECPSASRAWNVWEVEDYGFGVFTTNIWLKLREVYTQLCDHRLMSAAVKDERAVHADMGYWIESQKNGSWKLEKASFIEVKTCTWPKSHTLWSNGVLESDMIIPKSLAGPISQHNHRPGYHTQTAGPWHLGKLELDFNYCEGTTVVISENCGTRGPSLRTTTVSGKLIHEWCCRSCTLPPLRYMGEDGCWYGMEIRPINEKEENMVKSLASAGSGKVDNFTMGVLCLAILFEEVMRGKFGKIHMIAGVLFTFVLLLSGQITWRDMAHTLIMIGSNASDRMGMGVTYLALIATFKIQPFLALGFFLRKLTSRENLLLGVGLAMAATLRLPEDIEQMANGIALGLMALKLITQFETYQLWTALVSLTCSNTIFTLTVAWRTATLILAGISLLPVCQSSSMRKTDWLPMTVAAMGAQPLPLFIFSLKDTLKRRSWPLNEGVMAVGLVSILASSLLRNDVPMAGPLVAGGLLIACYVITGTSADLTVEKAADVTWEEEAEQTGVSHNLMVTVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTHNGKRLEPNWASVKKDLISYGGGWRLSAQWQKGEEVQVIAVEPGKNPKNFQTMPGIFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFVGKTVWFVPSIKAGNDIANCLRKNGKKVIQLSRKTFDTEYQKTKLNDWDFVVTTDISEMGANFKADRVIDPRRCLKPVILTDGPERVILAGPMPVTVASAAQRRGRVGRNPQKENDQYIFMGQPLNNDEDHAHWTEAKMLLDNINTPEGIIPALFEPEREKSAAIDGEYRLKGESRKTFVELMRRGDLPVWLAHKVASEGIKYTDRKWCFDGERNNQILEENMDVEIWTKEGEKKKLRPRWLDARTYSDPLALKEFKDFAAGRKSIALDLVTEIGRVPSHLAHRTRNALDNLVMLHTSEHGGRAYRHAVEELPETMETLLLLGLMILLTGGAMLFLISGKGIGKTSIGLICVIASSGMLWMADVPLQWIASAIVLEFFMMVLLIPEPEKQRTPQDNQLAYVVIGILTLAAIVAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLAAAVLLLVTHYAIIGPGLQAKATREAQKRTAAGIMKNPTVDGIMTIDLDPVIYDSKFEKQLGQVMLLVLCAVQLLLMRTSWALCEVLTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVSSVNMVSRLLLNRFTMTHRRPTIEKDVDLGAGTRHVNAEPETPNMDVIGERIKRIKEEHSSTWHYDDENPYKTWAYHGSYEVKATGSASSMINGVVKLLTKPWDVVPMVTQMAMTDTTPFGQQRVFKEKVDTRTPRPMPGTRKVMEITAEWLWRTLGRNKRPRLCTREEFTKKVRTNAAMGAVFTEENQWDSARAAVEDEEFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPKGTVMDIISRKDQRGSGQVGTYGLNTFTNMEAQLIRQMEGEGVLSKADLENPHPLEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLRETACLGKAYAQMWALMYFHRRDLRLASNAICSAVPVHWVPTSRTTWSIHAHHQWMTTEDMLTVWNRVWIEDNPWMEDKTPVTTWEDVPYLGKREDQWCGSLIGLTSRATWAQNILTAIQQVRSLIGNEEFLDYMPSMKRFRKEEESEGAIW

SEQ ID NO: 5106 - protein, 3290 aa, Artificial Sequence
  derived and/or modified protein sequence (wt) from DENV-3__JQ920487__SS-prME
TSLCLMMMLPATLAFHLTSRDGEPRMIVGKNERGKSLLFKTASGINMCTLIAMDLGEMCDDTVTYKCPLITEVEPEDIDCWCNLTSTWVTYGTCNQAGEHRRDKRSVALAPHVGMGLDTRTQTWMSAEGAWRQVEKVETWAFRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNVTTDSRCPTQGEAILPEEQDQNYVCKHTYVDRGWGNGCGLFGKGSLVTCAKFQCLESIEGKAVQHENLKYTVIITVHTGDQHQVGNETQGVTAEITPQASTVEAILPEYGTLGLECSPRTGLDFNEMILLTMKNKAWMVHRQWFFDLPLPWTSGATTETPTWNKKELLVTFKNAHAKKQEVVVLGSQEGAMHTALTGATEIQTSGGTSIFAGHLKCRLKMDKLELKGMSYAMCLNAFVLKKEVSETQHGTILIKVEYKGEDAPCKIPFSTEDGQGKAHNGRLITANPIVTKKEEPVNIEAEPPFGESNIVIGIGDKALKINWYKKGSSIGKMFEATARGARRMAILGDTAWDFGSVGGVLNSLGKMVHQIFGSAYTALFSGVSWIMKIGIGVLLTWIGLNSKNTSMSFSCIVIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDVIGVLEQGKRTLTPQPMELKYSWKTWGKAKIVTAETQNSSFIIDGPNTPECPSASRAWNVWEVEDYGFGVFTTNIWLKLREMYTQLCDHRLMSAAVKDERAVHADMGYWIESQKNGSWKLEKASLIEVKTCTWPKSHTLWSNGVLESDMIIPKSLAGPISQHNYRPGYHTQTAGPWHLGKLELDFNYCEGTTVVITENCGTRGPSLRTTTVSGKLIHEWCCRSCTLPPLRYMGEDGCWYGMEIRPINEKEENMVKSLVSAGSGKADNFTMGVLCLAILFEEVMRGKFGKKHMIAGALFTFVLLLSGQITWRDMAHTLIMIGSNASDRMGMGVTYLALIATFKIQPFLALGFFLRKLTSRENLLLGVGLAMATTLQLPEDIEQMANGIALGLMALKLITQFETYQLWTALVSLMCSNTIFTLTVAWRTATLILAVISLLPVCQSSSMRKTDWLPMTVAAMGVPPLPLFIFSLKDTLKRRSWPLNEGVMAVGLVSILASSFLRNDVPMAGPLVAGGLLIACYVITGTSADLTVEKAADVTWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTHNGKRLEPNWANVKKDLISYGGGWKLSAQWQKGEEVQVIAVEPGKNPKNFQTMPGIFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIVMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTVASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGERNNQILEENMDVEIWTKEGEKKKLRPRWLDARTYSDPLALKEFKDFAAGRKSIALDLVTEIGRVPSHLAHRTRNALDNLVMLHTSEHGGRAYRHAVEELPETMETLLLLGLMILLTGGAMLFLISGKGIGKTSIGLICVVASSGMLWMADVPLQWIASAIVLEFFMMVLLIPEPEKQRTPQDNQLAYVVIGILTLAAIVAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLVTHYAIIGPGLQAKATREAQKRTAAGIMKNPTVDGIMTIDLDPVIYDSKFEKQLGQVMLLVLCAVQLLLMRTSWAFCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVSSVNMVSRLLLNRFTMTHRRPTIEKDVDLGAGTRHVNAEPETPNMDVIGERIRRIKEEHSSTWHYDDENPYKTWAYHGSYEVKATGSASSMINGVVKLLTKPWDVVPMVTQMAMTDTTPFGQQRVFKEKVDTRTPRPMPGTRKVMEITAEWLWRTLGRNKRPRLCTREEFIKKVRTNAAMGAVFTEENQWDSARAAVEDEEFWKLVDRERELHKLGKCGSCVYNMMGKREKKLGEFGKAKGSRAIWYMWLGARYLEFEALGFLNEDHWFSRENSHSGVEGEGLHKLGYILRDISKIPGGAMYADDTAGWDTRITEDDLHNEEKITQQMDPEHRQLANAIFKLTYQNKVVKVQRPTPKGTVMDIISRKDQRGSGQVGTYGLNTFTNMEAQLIRQMEGEGVLSKADLENPHLLEKKVTQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLRETACLGKAYAQMWALMYFHRRDLRLASNAICSAVPVHWVPTSRTTWSIHAHHQWMTTEDMLTVWNRVWIEDNPWMEDKTPVTTWEDVPYLGKREDQWCGSLIGLTSRATWAQNILTAIQQVRSLIGNEEFLDYMPSMKRFRKEEESEGAIW

SEQ ID NO: 5107 - protein, 3290 aa, Artificial Sequence
  derived and/or modified protein sequence (wt) from DENV-3__JQ920488__SS-prME
TSLCLMMMLPATLAFHLTSRDGEPRMIVGKNERGKSLLFKTASGINMCTLIAMDLGEMCDDTVTYKCPLITEVEPEDIDCWCNLTSTWVTYGTCNQAGEHRRDKRSVALAPHVGMGLDTRTQTWMSAEGAWRQVEKVETWAFRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNVTTDSRCPTQGEAILPEEQDQNYVCKHTYVDRGWGNGCGLFGKGSLVTCAKFQCLESIEGKAVQHENLKYTVIITVHTGDQHQVGNETQGVTAEITPQASTVEAILPEYGTLGLECSPRTGLDFNEMILLTMKNKAWMVHRQWFFDLPLPWTSGATTETPTWNKKELLVTFKNAHAKKQEVVVLGSQEGAMHTALTGATEIQTSGGTSIFAGHLKCRLKMDKLELKGMSYAMCLNAFVLKKEVSETQHGTILIKVEYKGEDAPCKIPFSTEDGQGKAHNGRLITANPIVTKKEEPVNIEAEPPFGESNIVIGIGDKALKINWYKKGSSIGKMFEATARGARRMAILGDTAWDFGSVGGVLNSLGKMVHQIFGSAYTALFSGVSWIMKIGIGVLLTWIGLNSKNTSMSFSCIVIGIITLYLGAVVQADMGCVINWKGKELKCGSGIFVTNEVHTWTEQYKFQADSPKRLATAIAGAWENGVCGIRSTTRMENLLWKQIANELNYILWENNIKLTIVVGDVIGVLEQGKRTLTPQPMELKYSWKTWGKAKIVTAETQNSSFIIDGPNTPECPSALRAWNVWEVEDYGFGVFTTNIWLKLREKYTQLCDHRLMSAAVKDERAVHADMGYWIESQKNESWKLEKASLIEVKTCTWPKSHTLWSNGVLESDMIIPKSLAGPISQHNYRPGYHTQTAGPWHLGKLELDFNYCEGTTVVITENCGIRGPSLRTTTVSGKLIHEWCCRSCTLPPLRYMGEDGCWYGMEIRPINEKEENMVKSLVSAGSGKTDNFTMGVLCLAILFEEVMRGKFGKKHMIAGALFTFVLLLSGQITWRDMAHTLIMIGSNASDRMGMGVTYLALIATFKIQPFLALGFFLRKLTSRENLLLGVGLAMATTLQLPEDIEQMANGIALGLMALKLITQFETYQLWTALISLMCSNTIFTLTVAWRTATLILAVISLLPVCQSSSMRKTDWLPMTVAAMGVPPLPLFIFSLKDTLKRRSWPLNEGVMAVGLVSILASSFLRNDVPMAGPLVAGGLLIACYVITGTSADLTVEKAADVTWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTHNGKRLEPNWANVKKDLISYGGGWKLGAQWQKGEEVQVIAVEPGKNPKNFQTMPGIFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIVMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTVASAAQRRGRVGRNSQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGERNNQILEENMDVEIWTKEGEKKKLRPRWLDARTYSDPLALKEFKDFAAGRKSIALDLVTEIGRVPSHLAHRTRNALDNLVMLHTSEHGGRAYRHAVEELPETMETLLLLGLMILLTGGAMLFLISGKGIGKTSIGLICVVASSGMLWMADVPLQWIASAIVLEFFMMVLLIPEPEKQRTPQDNQLAYVVIGILTLAAIVAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLVTHYAIIGPGLQAKATREAQKRTAAGIMKNPTVDGIMTIDLDPVIYDSKFEKQLGQVMLLVLCAVQLLLMRTSWAFCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVSSVNMVSRLLLNRFTMTHRRPTIEKDVDLGAGTRHVNAEPETPNMDVIGERIRRIKEEHSSTWHYDDENPYKTWAYHGSYEVKATGSASSMINGVVKLLTKPWDVVPMVTQMAMTDTTPFGQQRVFKEKVDTRTPRPMPGTRKVMEITAEWLWRTLGRNKRPRLCTREEFIKKVRTNAAMGAVFTEENQWDSARAAVEDEEFWKLVDRERELHKLGKCGSCVYNMMGKREKKLGEFGKAKGSRAIWYMWLGARYLEFEALGFLNEDHWFSRENSHSGVEGEGLHKLGYILRDISKIPGGAMYADDTAGWDTRITEDDLHNEEKITQQMDPEHRQLANAIFKLTYQNKVVKVQRPTPKGTVMDIISRKDQRGSGQVGTYGLNTFTNMEAQLIRQMEGEGVLSKADLENPHLLEKKVTQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLRETACLGKAYAQMWALMYFHRRDLRLASNAICSAVPVHWVPTSRTTWSIHAHHQWMTTEDMLTVWNRVWIEDNPWMEDKTPVTTWEDVPYLGKREDQWCGSLIGLTSRATWAQNILTAIQQVRSLIGNEEFLDYMPSMKRFRKEEESEGAIW

SEQ ID NO: 5108 - protein, 3290 aa, Artificial Sequence
  derived and/or modified protein sequence (wt) from DENV-3__JQ920489__SS-prME
TSLCLMMMLPATLAFHLTSRDGEPRMIVGKNERGKSLLFKTASGINMCTLIAMDLGEMCDDTVTYKCPLITEVEPEDIDCWCNLTSTWVTYGTCNQAGEHRRDKRSVALAPHVGMGLDTRTQTWMSAEGAWRQVEKVETWAFRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAILPEEQDQNYVCKHTYVDRGWGNGCGLFGKGSLVTCAKFQCLESIEGKAVQHENLKYTVIITVHTGDQHQVGNETQGVTAEITPQASTVEAILPEYGTLGLECSPRTGLDFNEMILLTMKNKAWMVHRQWFFDLPLPWTSGATTETPTWNKKELLVTFKNAHAKKQEVVVLGSQEGAMHTALTGATEIQTSGGTSIFAGHLKCRLKMDKLELKGMSYAMCLNAFVLKKEVSETQHGTILIKVEYKGEDAPCKIPFSTEDGQGKAHNGRLITANPIVTKKEEPVNIEAEPPFGESNIVIGIGDKALKINWYKKGSSIGKMFEATARGARRMAILGDTAWDFGSVGGVLNSLGKMVHQIFGSAYTALFSGVSWIMKIGIGVLLTWIGLNSKNTSMSFSCIVIGIITLYLGAVVQADMGCVINWKGKELKCGSGIFVTNEVHTWTEQYKFQADSPKRLATAIAGAWENGVCGIRSTTRMENLLWKQIANELNYILWENNIKLTIVVGDVIGVLEQGKRTLTPQPMELKYSWKTWGKAKIVTAETQNSSFIIDGPNTPECPSASRAWNVWEVEDYGFGVFTTNIWLKLREKYTQLCDHRLMSAAVKDERAVHADMGYWIESQKNGSWKLEKASLIEVKTCTWPKSHTLWSNGVLESDMIIPKSLAGPISQHNYRPGYHTQTAGPWHLGKLELDFNYCEGTTVVITENCGIRGPSLRTTTVSGKLIHEWCCRSCTLPPLRYMGEDGCWYGMEIRPINEKEENMVKSLVSAGSGKTDNFTMGVLCLAILFEEVMRGKFGKKHMIAGALFTFVLLLSGQITWRDMAHTLIMIGSNASDRMGMGVTYLALIATFKIQPFLALGFFLRKLTSRENLLLGVGLAMATTLQLPEDIEQMANGIALGLMALKLITQFETYQLWTALISLMCSNTIFTLTVAWRTATLILAVISLLPVCQSSSMRKTDWLPMTVAAMGVPPLPLFIFSLKDTLKRRSWPLNEGVMAVGLVSILASSFLRNDVPMAGPLVAGGLLIACYVITGTSADLTVEKAADVTWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTHNGKRLEPNWANVKKDLISYGGGWKLSAQWQKGEEVQVIAVEPGKNPKNFQTMPGIFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIVMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTVASAAQRRGRVGRNSQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGERNNQILEENMDVEIWTREGEKKKLRPRWLDARTYSDPLALKEFKDFAAGRKSIALDLVTEIGRVPSHLAHRTRNALDNLVMLHTSEHGGRAYRHAVEELPETMETLLLLGLMILLTGGAMLFLISGKGIGKTSIGLICVVASSGMLWMADVPLQWIASAIVLEFFMMVLLIPEPEKQRTPQDNQLAYVVIGILTLAAIVAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLVTHYAIIGPGLQAKATREAQKRTAAGIMKNPTVDGIMTIDLDPVIYDSKFEKQLGQVMLLVLCAVQLLLMRTSWAFCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRIEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVSSVNMVSRLLLNRFTMTHRRPTIEKDVDLGAGTRHVNAEPETPNMNVIGERIRRIKEEHSSTWHYDDENPYKTWAYHGSYEVKATGSASSMINGVVKLLTKPWDVVPMVTQMAMTDTTPFGQQRVFKEKVDTRTPRPMPGTRKVMEITAEWLWRTLGRNKRPRLCTREEFIKKVRTNAAMGAVFTEENQWDSARAAVEDEEFWKLVDRERELHKLGKCGSCVYNMMGKREKKLGEFGKAKGSRAIWYMWLGARYLEFEALGFLNEDHWFSRENSHSGVEGEGLHKLGYILRDISKIPGGAMYADDTAGWDTRITEDDLHNEEKITQQMDPEHRQLANAIFKLTYQNKVVKVQRPTPKGTVMDIISRKDQRGSGQVGTYGLNTFTNMEAQLIRQMEGEGVLSKADLENPHLLEKKVTQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLRETACLGKAYAQMWALMYFHRRDLRLASNAICSAVPVHWVPTSRTTWSIHAHHQWMTTEDMLTVWNRVWIEDNPWMEDKTPVTTWEDVPYLGKREDQWCGSLIGLTSRATWAQNILTAIQQVRSLIGNEEFLDYMPSMKRFRKEEESEGAIW

SEQ ID NO: 5109 - protein, 3290 aa, Artificial Sequence
  derived and/or modified protein sequence (wt) from DENV-3__KF824902__SS-prME
TSLCLMMMLPATLAFHLTSRDGEPRMIVGKNERGKSLLFKTASGINMCTLIAMDLGEMCDDTVTYKCPLIAEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMAMRCVGVGNRDFVEGLSGATWVDVVLEHGGCVTTMAKNKPTLDIELQKTEATQLATLRKLCIEGKITNITTDSRCPTQGEAILPEEQDQNYVCKHTYVDRGWGNGCGLFGKGSLVTCAKFQCLESIEGKVVQHENLKYTVTITVHTGDQHQVGNDTQGVTAEITPQASTVEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCLNTFVLKKEVSETQHGTILIKVEYKGEDAPCKIPFSTEDGQGKAHNGRLITANPVVTKKEEPVNIEAEPPFGESNIVIGIGDKALKINWYKKGSSIGKMFEATARGARRMAILGDTAWDFGSVGGVLNSLGKMVHQIFGSAYTALFGGVSWIMKIGIGVLLTWIGLNSKNTSMSFSCIVIGIITLYLGTVVQADMGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRALTPQPMELKYSWKTWGKAKIVTAEIQNSSFIIDGPNTPECPSASRAWNVWEVEDYGFGVFTTNIWLKLREVYTQTCDHRLMSAAIKDERAVHADMGYWIESQKNGSWKLEKASFIEVKTCTWPKTHTLWSNGVLESDMIIPKSLAGPISQHNHRPGYHTQTAGPWHLGKLELDFNYCEGTTVVITENCGTRGPSLRTTTVSGKLIHEWCCRSCTLPPLRYMGEDGCWYGMEIRPINEKEENMVKSLVSAGSGKVDNFTMGVLCLAILFEEVMRGKFGKKHMIAGVLFTFMLLLSGQITWRDMAHTLIMIGSNASDRMGMGVTYLALIATFKIQPFLALGFFLRKLTSRENLLLGVGLAMATTLQLPEDIEQMANGIALGLMALKLITQFETYQLWTALVSLTCSNTIFTLTVAWRTATLILAGVSLLPVCQSSSMRKTDWLPVAVAAMGVPPLPLFIFSLKDTLKRRSWPLNEGVMAVGLVSILASSLLRNDVPMAGPLVAGGLLIACYVITGTSADLTVEKAADVTWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTHNGKRLEPNWASVKKDLISYGGGWRLSAQWQKGEEVQVIAVEPGRNPKNFQTMPGIFQTTTGEIGAIALDFKPGTSGSPIINREGKVVGLYGNGVVTKNGGYVSGIAQANAEPEGPTPELEEEMFKKRNLTIMDLHPGSGKTRKYLPAIVREAIKRRLRTLILAPTRVVAAEMEEALKGLPIRYQTTATKSEHTGREIVVLMCHATFTMRLLSPVRVPNYNLIIMDEAHFTDPASIAARGYISTRVGMGEAAAIFMTATPPGTAEAFPQSNAPIQDEERDIPERSWNSGNEWITDFVGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFMGQPLNNDEDHAHWTEAKMLLDNINTPEGIIPALFEPEREKSAAIDGEYRLKGESRKTFVELMRRGDLPVWLAHKVASEGIKYTDRKWCFDGERNNQILEENMDVEIWTKEGERKKLRPRWLDARTYSDPLALKEFKDFAAGRKSIALDLVTEIGRVPSHLAHRTRNALDNLVMLHTSEHGGRAYRHAVEELPETMETLLLLGLMILLTGGAMLFLISGKGIGKTSIGLICVIVSSGMLWMADVPLQWIASAIVLEFFMMVLLIPEPEKQRTPQDNQLAYVVIGILTLAAIVAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLVTHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRREFELYKKSGITEVDRTEAKEGLKRGETTHHAVSRGSAKLQWFVERNMVIPEGRVIDLGCGRGGWSYYCAGLKKVTEVRGYTKGGPGHEEPVPMSTYGWNTVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVSSVNMVSRLLLNRFTMTHRRPTIEKDVDLGAGTRHVNAEPETPNMDVIGERIKRIKEEHSSTWHYDDENPYKTWAYHGSYEVKATGSASSMINGVVKLLTKPWDVVPMVTQMAMTDTTPFGQQRVFKEKVDTRTPRPMPGTRKVMEITAEWLWRTLGRNKRPRLCTREEFTKKVRTNAAMGAVFTEENQWESARAAVEDEEFWKLVGRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPKGTVMDIISRKDQRGSGQVGTYGLNTFTNMEAQLIRQMEGEGVLSKADLENPHLLEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLKETACLGKAYAQMWSLMYFHRRDLRLASNAICSAVPVHWVPTSRTTWSIHAHHQWMTTEDMLTVWNRVWIEDNPWMEDKTPVTTWEDVPYLGKREDQWCGSLIGLTSRATWAQNILTAIQQVRSLIGDEEFLDYMPSMKRFRKEEESEGAIW

SEQ ID NO: 5110 - protein, 3290 aa, Artificial Sequence
  derived and/or modified protein sequence (wt) from DENV-3__KF824903__SS-prME
TSLCLMMMLPATLAFHLTSRDGEPRMIVGKNERGKSLLFKTASGINMCTLIAMDLGEMCDDTVTYKCPLIAEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMAMRCVGVGNRDFVEGLSGATWVDVVLEHGGCVTTMAKNKPTLDIELQKTEATQLATLRKLCIEGKITNITTDSRCPTQGEAILPEEQDQNYVCKHTYVDRGWGNGCGLFGKGSLVTCAKFQCLESIEGKVVQHENLKYTVTITVHTGDQHQVGNDTQGVTAEITPQASTVEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCLNTFVLKKEVSETQHGTILIKVEYKGEDAPCKIPFSTEDGQGKAHNGRLITANPVVTKKEEPVNIEAEPPFGESNIVIGIGDKALKINWYKKGSSIGKMFEATARGARRMAILGDTAWDFGSVGGVLNSLGKMVHQIFGSAYTALFGGVSWIMKIGIGVLLTWIGLNSKNTSMSFSCIVIGIITLYLGTVVQADMGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRALTPQPMELKYSWKTWGKAKIVTAEIQNSSFIIDGPNTPECPSASRAWNVWEVEDYGFGVFTTNIWLKLREVYTQTCDHRLMSAAIKDERAVHADMGYWIESQKNGSWKLEKASFIEVKTCTWPKSHTLWSNGVLESDMIIPKSLAGPISQHNHRPGYHTQTAGPWHLGKLELDFNYCEGTTVVITENCGTRGPSLRTTTVSGKLIHEWCCRSCTLPPLRYMGEDGCWYGMEIRPINEKEENMVKSLVSAGSGKVDNFTMGVLCLAILFEEVMRGKFGKKHMIAGVLFTFMLLLSGQITWRDMAHTLIMIGSNASDRMGMGVTYLALIATFKIQPFLALGFFLRKLTSRENLLLGVGLAMATTLQLPEDIEQMANGIALGLMALKLITQFETYQLWTALVSLTCSNTIFTLTVAWRTATLILAGVSLLPVCQSSSMRKTDWLPVAVAAMGVPPLPLFIFSLKDTLKRRSWPLNEGVMAVGLVSILASSLLRNDVPMAGPLVAGGLLIACYVITGTSADLTVEKAADVTWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTHNGKRLEPNWASVKKDLISYGGGWRLSAQWQKGEEVQVIAVEPGRNPKNFQTMPGIFQTTTGEIGAIALDFKPGTSGSPIINREGKVVGLYGNGVVTKNGGYVSGIAQANAEPEGPTPELEEEMFKKRNLTIMDLHPGSGKTRKYLPAIVREAIKRRLRTLILAPTRVVAAEMEEALKGLPIRYQTTATKSEHTGREIVECMCHATFTMRLLSPVRVPNYNLIIMDEAHFTDPASIAARGYISTRVGMGEAAAIFMTATPPGTAEAFPQSNAPIQDEERDIPERSWNSGNEWITDFVGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGERNNQILEENMDVEIWTKEGERKKLRPRWLDARTYSDPLALKEFKDFAAGRKSIALDLVTEIGRVPSHLAHRTRNALDNLVMLHTSEHGGRAYRHAVEELPETMETLLLLGLMILLTGGAMLFLISGKGIGKTSIGLICVIVSSGMLWMADVPLQWIASAIVLEFFMMVLLIPEPEKQRTPQDNQLAYVVIGILTLAAIVAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLVTHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRREFELYKKSGITEVDRTEAKEGLKRGETTHHAVSRGSAKLQWFVERNMVIPEGRVIDLGCGRGGWSYYCAGLKKVTEVRGYTKGGPGHEEPVPMSTYGWNTVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVSSVNMVSRLLLNRFTMTHRRPTIEKDVDLGAGTRHVNAEPETPNMDVIGERIKRIKEEHSSTWHYDDENPYKTWAYHGSYEVKATGSASSMINGVVKLLTKPWDVVPMVTQMAMTDTTPFGQQRVFKEKVDTRTPRPMPGTRKVMEITAEWLWRTLGRNKRPRLCTREEFTKKVRTNAAMGAVFTEENQWESARAAVEDEEFWKLVGRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPKGTVMDIISRKDQRGSGQVGTYGLNTFTNMEAQLIRQMEGEGVLSKADLENPHLLEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLKETACLGKAYAQMWSLMYFHRRDLRLASNAICSAVPVHWVPTSRTTWSIHAHHQWMTTEDMLTVWNRVWIEDNPWMEDKTPVTTWEDVPYLGKREDQWCGSLIGLTSRATWAQNILTAIQQVRSLIGDEEFLDYMPSMKRFRKEEESEGAIW

SEQ ID NO: 5111 - protein, 3290 aa, Artificial Sequence
  derived and/or modified protein sequence (wt) from DENV-3__JF504679__SS-prME
TSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAVLPEEQDQNYVCKHTYVDRGWGNGCGLFGKGSLVTCAKFQCLEPIEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDAPCKIPFSTEDGQGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQADMGCVINWKGKELKCGSGIFVTNEVHTWTEQYKFQADSPKRLATVIAGAWENGVCGIRSTTRMENLLWKQIANELNYILWENNIKLTVVVGDTIGVLEQGKRTLTPQPMELKYSWKTWGKAKIVTAETQNSSFIIDGPNTPECPSASRAWNVWEVEDYGFGVFTTNIWLKLREVYTQMCDHRLMSAAVKDERAVHADMGYWIESQKNGSWKLEKASLIEVKTCTWPKSHTLWSNGVLESDMIIPKSLAGPVSQHNYRPGYHTQTAGPWHLGKLELDFNYCEGTTVVITENCGTRGPSLRTTTVSGKLIHEWCCRSCTLPPLRYMGEDGCWYGMEIRPISEREENMVKSLVSAGSGKVDNFTMGVLCLAILFEEVMRGKFGKKHMIAGVFFTFMLLLSGQITWRDMAHTLIMIGSNASDRMGMGVTYLALIATFKIQPFLALGFFLRKLTSRENLLLGVGLAMATTIQLPEDIEQMANGIALGLMALKLITQFETYQLWTALISLTCSNTIFTLTVAWRTATLILAGVSLLPVCQSSSMRKTDWLPMTVAAMGVPPLPLFIFSLKDTLKRRSWPLNEGVMAVGLVSILASSLLRNDVPMAGPLVAGGLLIACYVITGTSADLTVEKAADVTWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGILGKTQVGVGVQKEGVFHTMWHVTRGAVLTHNGKRLEPNWASVKKDLISYGGGWRLSAQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTVASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKDFAAGRKSIALDLVTEIGRVPSHLAHRTRNALDNLVMLHTSEHGGRAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLVTHYAIIGPGLQAKATREAQKRTAAGIMKNPTVDGIITIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGETTHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPAVIEHLERLQRKHGGMLVRNPLSRNSTHEMYWISNGTGNIVSSVNMVSRLLLNRFTMTHRRPTIEKDVDLGAGTRHVNAEPETPNMDVIGERIRRIKEEHNSTWHYDDENPYKTWAYHGSYEVKATGSASSMINGVVKLLTKPWDVVPMVTQMAMTDTTPFGQQRVFKEKVDTRTPRPMPGTRKVMEITAEWLWRTLGRNKRPRLCTREEFTKKVRTNAAMGAVFTEENQWDSAKAAVEDEEFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMNPEHRLLANAIFKLTYQNKVVKVQRPTPTGTVMDIISRKDQRGSGQVGTYGLNTFTNMEAQLVRQMEGEGVLSKADLENPHLPEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLRETACLGKAYAQMWSLMYFHRRDLRLASNAICSAVPVHWVPTSRTTWSIHAHHQWMTTEDMLTVWNRVWIEDNPWMEDKTPVTTWENVPYLGKREDQWCGSLIGLTSRATWAQNIPTAIQQVRSLIGNEEFLDYMPSMKRFRKEEESEGAIW

SEQ ID NO: 5112 - protein, 3290 aa, Artificial Sequence
  derived and/or modified protein sequence (wt) from DENV-3__KC425219__SS-prME
TSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGERRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAVLPEEQDQNYVCKHTYVDRGWGNGCGLFGKGSLVTCAKFQCLEPIEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYRGEDAPCKIPFSTEDGQGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNPKNTSMSFSCIAIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSASRAWNVWEVEDYGFGVFTTNIWLKLREVYTQLCDHRLMSAAVKDERAVHADMGYWIESQKNGSWKLEKASLIEVKTCTWPKSHTLWSNGVLESDMIIPKSLAGPISQHNHRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGKVDNFTMGVLCLAILFEEVMRGKFGKKHMIAGVFFTFVLLLSGQITWRDMAHTLIMIGSNASDRMGMGVTYLALIATFKIQPFLALGFFLRKLTSRENLLLGVGLAMATTLQLPEDIEQMANGIALGLMALKLITQFETYQLWTALISLTCSNTMFTLTVAWRTATLILAGVSLLPVCQSSSMRKTDWLPMAVAAMGVPPLPLFIFSLKDTLKRRSWPLNEGVMAVGLVSILASSLLRNDVPMAGPLVAGGLLIACYVITGTSADLTVEKAADITWEEEAEQTGVSHNLMITVDDDGTMRIKDDETENILTVLLKTALLIVSGVFPYSIPATLLVWHTWQKQTQRSGVLWDVPSPPETQKAELEEGVYRIKQQGIFGKTQVGVGVQKEGVFHTMWHVTRGAVLTYNGKRLEPNWASVKKDLISYGGGWRLSAQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKDFAAGRKSIALDLVTEIGRVPSHLAHRTRNALDNLVMLHTSEHGGRAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVASVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRSMPGTRRVMGITAEWLWRTLGRNKKPRLCTREEFTKKVRTNAAMGAVFTEENQWDSAKAAVEDEDFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPTGTVMDIISRKDQRGSGQVGTYGLNTFTNMEAQLIRQMEGEGVLSKADLENPHLPEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLRETACLGKAYAQMWSLMYFHRRDLRLASNAICSAVPVHWVPTSRTTWSIHAHHQWMTTEDMLTVWNRVWIEDNPWMEDKTPVTTWENVPYLGKREDQWCGSLIGLTSRATWAQNIPTAIQQVRSLIGNEEFLDYMPSMKRFRKEEESEGAIW

SEQ ID NO: 5113 - protein, 3290 aa, Artificial Sequence
  derived and/or modified protein sequence (wt) from DENV-3__AY858037__SS-prME
TSLCLMMMLPVTLAFHLTSRDGEPRMIVGKNERGKSLLFKTASGINMCTLIAMDLGEMCDDTVTYKCPLITEVEPEDIDCWCNLTSTWVTYGTCNQAGEHRRDKRSVALAPHVGMGLDTRAQTWMSAEGAWRQVEKVETWAFRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNVTTDSRCPTQGEAILPEEQDQNYVCKHTYVDRGWGNGCGLFGKGSLVTCAKFQCLESIEGKVVQHENLKYTVIITVHTGDQHQVGNETQGVTAEITPQASTVEAILPEYGTLGLECSPRTGLDFNEMILLTMKNKAWMVHRQWFFDLPLPWTSGATTETPTWNKKELLVTFKNAHAKKQEVVVLGSQEGAMHTALTGATEIQTSGGTSIFAGHLKCRLKMDKLELKGMSYAMCSNAFVLKKEVSETQHGTILIKVEYKGEDAPCKIPFSTEDGQGKAHNGRLITANPVVTKKEEPVNIEAEPPFGESNIIIGIGDRALKINWYKKGSSIGKMFEATARGARRMAILGDTAWDFGSVGGVLNSLGKMVHQIFGSAYTALFSGVSWIMKIGIGVLLTWIGLNSKNTSMSFSCIVIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPNASRAWNVWEVEDYGFGVFTTNIWLKLREMYTQLCDHRLMSAAVKDERAVHADMGYWIESQKNGSWKLEKASLIEVKTCTWPKSHTLWSNGVLESDMIIPKSLAGPISQHNYRPGYHTQTAGPWHLGKLELDFNYCEGTTVVITENCGTRGPSLRTTTVSGKLIHEWCCRSCTLPPLRYMGEDGCWYGMEIRPINEKEENMVKSLVSAGSGKVDNFTMGVLCLAILFEEVMRGKFGKKHMIAGVLFTFVLLLSGQITWRDMARTLIMIGSNASDRMGMGVTYLALIATFKIQPFLALGFFLRKLTSRENLLLGVGLAMATTLQLPEDIEQMANGIALGLMALKLITQFETYQLWTALVSLMCSNTIFTLTVAWRTATLILAGISLFPVCQSSSMRKTDWLPMTVAAMGVPPLPLFIFSLKDTLKRRSWPLNEGVMAVGLVSILASSLLRNDVPMAGPLVAGGLLIACYVITGTSADLTVEKAADVTWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTYNGKRLEPNWASVKKDLISYGGGWRLSAQWQKGEEVQVIAVEPGKNPKNFQTMPGIFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGKEIVDLMCHATFTMRLLSPVRVPNYNLIIMDEAHFTDPASIAARGYISTRVGMGEAAAIFMTATPPGTADAFPQSNAPIQDEERDIPERSWNSGNDWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTVASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGERNNQILEENMDVEIWTKEGEKKKLRPRWLDARTYSDPLALKEFKDFAAGRKSIALDLVTEIGRVPSHLAHRTRNALDNLVMLHTSEHGGRAYRHAVEELPETMETLLLLGLMILLTGGAMLFLISGKGVGKTSIGLICVVASSGMLWMADIPLQWIASAIVLEFFMMVLLIPEPEKQRTPQDNQLAYVVIGILTLAAIVAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLVTHYAIIGPGLQAKATREAQKRTAAGIMKNPTVDGIMTIDLDPVIYDSKFEKQLGQVMLLVLCAVQLLLMRTSWAFCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVSSVNMVSRLLLNRFTMTYRRPTIEKDVDLGAGTRHVNAEPETPNMDVIGERIRRIKEEHSSTWHYDDENPYKTWAYHGSYEVKATGSASSMINGVVKLLTKPWDVVPTVTQMAMTDTTPFGQQRVFKEKVDTRTPKPMPGTRKVMEITAEWLWRTLGRNKRPRLCTREEFTKKVRTNAAMGAVFTEENQWDSARAAVEDEEFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPKGTVMDIISRKDQRGSGQVGTYGLNTFTNMEAQLIRQMEGEGVLSKTDLENPHLLEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLKETACLGKAYAQMWALMYFHRRDLRLASNAICSAVPVHWVPTSRTTWSIHAHHQWMTTEDMLTVWNRVWIEDNPWMEDKTPVTTWEDVPYLGKREDQWCGSLIGLTSRATWAQNILTAIQQVRSLIGNEEFLDYMPSMKRFRKEEESEGAIW

SEQ ID NO: 5114 - protein, 3290 aa, Artificial Sequence
  derived and/or modified protein sequence (wt) from DENV-3__KJ737429__SS-prME
TSLCLMMMLPATLAFHLTSRDGEPRMIVGKNERGKSLLFKTASGINMCTLIAMDLGEMCDDTVTYKCPLIAEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAILPEEQDQNYVCKHTYVDRGWGNGCGLFGKGSLVTCAKFQCLEPIEGKVVQYENLKYTVIITVHTGDQHQVGNDTQGVTVEITPQASTVEAVLPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCLNTFVLKKEVSETQHGTILIKVEYKGEDAPCKIPFSTEDGQGKAHNGRLITANPVVTKKEEPVNIEAEPPFGESNIVIGIGDKALKINWYKKGSSIGKMFEATARGARRMAILGDTAWDFGSVGGVLNSLGKMVHQIFGSAYTALFSGVSWIMKIGIGVLLTWIGLNSKNTSMSFSCIVIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSASRAWNVWEVEDYGFGVFTTNIWLKLREVYTQSCDHRLMSAAIKDERAVHADMGYWIESQKNGSWKLEKASFIEVKTCTWPKSHTLWSNGVLESDMIIPKSLAGPISQHNHRPGYHTQTAGPWHLGKLELDFNYCEGTTVVITENCGTRGPSLRTTTVSGKLIHEWCCRSCTLPPLRYMGEDGCWYGMEIRPINEKEENMVKSLVSAGSGKVDNFTMGVLCLAILFEEVMRGKFGKKHMIAGVLFTFVLLLSGQITWRDMAHTLIMIGSNASDRMGMGVTYLALIATFKIQPFLALGFFLRKLTSRENLLLGVGLAMATTLQLPEDIEQMANGIALGLMTLKLITQFETYQLWTALVSLTCSNTIFTLTVAWRTATLILAGVSLLPLCQSSSMRKTDWLPMTVAAMGVPPLPLFIFSLKDTPKRRSWPLNEGVMAVGLVSILASSLLRNDVPMAGPLVAGGLLIACYVITGTSADLTVEKAADVTWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTHNGKRLEPNWASVKKDLISYGGGWRLSAQWQKGEEVQVIAVEPGKNPKNFQTMPGIFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTAEAFPQSNAPIQDEERDIPERSWNSGNEWITDFVGKTVWFVPSIKAGNDIANCLRKNGKKVIQLSRKTFDTEYQKTRLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGERNNQILEENMDVEIWTKEGERKKLRPRWLDARTYSDPLALKEFKDFAAGRKSIALDLVTEIGRVPSHLAHRTRNALDNLVMLHTSEHGGRAYRHAVEELPETMETLLLLGLMILLTGGAMLFLISGKGIGKTSIGLICVIVSSGMLWMADVPLQWIASAIVLEFFMMVLLIPEPEKQRTPQDNQLAYVVIGILTLAAIVAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLVTHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGRRGTGSQGETLGEKWKKKLNQLSRKEFDLYKKSGITEVDRTEAKEGLKRGETTHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKYGGMLVRNPLSRNSTHEMYWISNGTGNIVSSVNMVSRLLLNRFTMTHRRPTIEKDVDLGAGTRHVNAEPETPNMDVIGERIKRIKEEHSSTWHYDDENPYKTWAYHGSYEVKATGSASSMINGVVKLLTKPWDVVPMVTQMAMTDTTPFGQQRVFKEKVDTRTPRPMPGTRKVMEITAEWLWRTLGRNKKPRLCTREEFTKKVRTNAAMGAVFTEENQWDSARAAVEDEEFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPKGTVMDIISRKDQRGSGQVGTYGLNTFTNMEAQLVRQMEGEGVLSKADLENPHLLEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLKETACLGKAYAQMWSLMYFHRRDLRLASNAICSAVPVHWVPTSRTTWSIHAHHQWMTTEDMLTVWNRVWIEDNPWMEDKTPVTTWEDVPYLGKREDQWCGSLIGLTSRATWAQNILTAIQQVRSLIGDEEFLDYMPSMKRFRKEEESEGAIW

SEQ ID NO: 5115 - protein, 3290 aa, Artificial Sequence
  derived and/or modified protein sequence (wt) from DENV-3__DQ863638__SS-prME
TSLCLMMMLPATLAFHLTSRDGEPRMIVGKNERGKSLLFKTASGINMCTLIAMDLGEMCDDTVTYKCPHIAEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLILVTPSMAMRCVGVGNRDFVEGLSGATWVDVVLEHGGCVTTMAKNKPTLDIELQKTEATQLATLRKLCIEGKITNITTDSRCPTQGEAILPEEQDQNYVCKHTYVDRGWGNGCGLFGKGSLVTCAKFQCLESIEGKVVQHENLKYTVIITVHTGDQHQVGNETQGVTAEITPQASTVEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCLNTFVLKKEVSETQHGTILIKVEYKGEDAPCKIPFSTEDGQGKAHNGRLITANPVVTKKEEPVNIEAEPPFGESNIVIGIGDKALKINWYKKGSSIGKMFEATARGARRMAILGDTAWDFGSVGGVLNSLGKMVHQIFGSAYTALFSGVSWIMKIGIGVLLTWIGLNSKNTSMSFSCIAIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPHTPECPRASRAWNVWEVEDYGFGVFTTNIWLKLREEYTQLCDHRLMSAAVKDERAVHADMGYWIESQKNGSWKLEKASLIEVKTCTWPKSHTLWSNGVLESDMIIPKSLAGPISQHNHRPGYHTQTAGPWHLGKLELDFNYCEGTTVVITENCGTRGPSLRTTTVSGKLIHEWCCRSCTLPPLRYMGEDGCWYGMEIRPINEKEENMVKSLASAGSGKVDNFTMGFLCLAILFEEVMRGKFGKKHMIAGVFLTFLLLLSGQITWRDMAHTLIMIGSNASDRMGMGVTYLALIATFKIQPFLALGFFLRKLTSRENFLLGVGLAMATTLQLPEDIEQMANGIALGLMALKLITQFETYQLWTALVSLTCSNTIFTLTVAWRTATLILAGVSLLPVCQSSSMRKTDWLPMAVAAMGVPPLPLFIFSLKDTLKRRSWPLNEGVMAVGLVSILASSLLRNDVPMAGPLVAGGLLIACYVITGTSADLTVEKAADVTWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTHNGKRLEPNWASVKKDLISYGGGWRLSAQWQKGEEVQVIAVEPGKNPKNFQTMPGIFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFVGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFRGQPLNNDEDHAHWTEAKMLLDNINTPEGIIPALFEPEREKSAAIDGEYRLKGESRKTFVELMRRGDLPVWLAHKVASEGIKYTDRKWCFDGERNNQILEENMDVEIWTKEGEKKKLRPRWLDARTYSDPLALKEFKDFAAGRKSIALDLVTEIGRVPSHLAHRTRNALDNLVMLHTSEHGGRAYRHAVEELPETMETLLLLGLMILLTGGAMLFLISGKGIGKTSIGLICVIASSGMLWMADVPLQWIASAIVLEFFMMVLLIPEPEKQRTPQDNQLAYVVIGILTLAAIVAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLATHYAIIGPGLQAKATREAQKRTAAGITKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGEITRHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVSSVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVIQMAMTDTTPFGQQRVFKEKVDTRTPRPMPGTRKVMEITAEWLWRTLGRNKRPRLCTREEFTKKVRTNAAMGAVFTEENQWDSARAAVEDEEFWKLVDRERELHKLGKCGSCVYNMMGKREKKLGEFGKAKGSRAIWYMWLGARYLEFEALGFFNEDHWFSRENSYSGVEGEGLHKLGYILRDISKIPGGAMYADDTAGWDTRITEDDLHNEEKITQQMDPEHRQLANAIFKLTYQNKVVKVQRPTPKGTVMDIISRKDQRGSGQVGTYGLNTFTNMEAQLVRQMEGEGVLSKADLENPHLLEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISRGAGWSLKETACLGKAYAQMWSLMYFHRRDLRLASNAICSAVPVHWVPTSRTTWSIHAHHQWMTTEDMLTVWNRVWIEDNPWMEDKTPVTTWEDVPYLGKREDQWCGSLIGLTSRATWAQNILTAIQQVRSLIGNEEFLDYMPSMKRFKKEEESEGAIW

SEQ ID NO: 5116 - protein, 3290 aa, Artificial Sequence
  derived and/or modified protein sequence (wt) from DENV-3__KJ737430__SS-prME
TSLCLMMMLPATLAFHLTSRDGEPRMIVGKNERGKSLLFKTASGINMCTLIAMDLGEMCDDTVTYKCPLIAEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMAMRCVGVGNRDFVEGLSGATWVDVVLEHGGCVTTMAKNKPTLDIELQKTEATQLATLRKLCIEGKITNITTDSRCPTQGEAILPEEQDQNYVCKHTYVDRGWGNGCGLFGKGSLVTCAKFQCLESIEGKVVQHENLKYTVIITVHTGDQHQVGNDTQGVTVEITPQASTVEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCLNTFVLKKEVSETQHGTILIKVEYKGEDAPCKIPFSTEDGQGKAHNGRLITANPVVTKKEEPVNIEAEPPFGESNIVIGIGDKALKINWYKKGSSIGKMFEATARGARRMAILGDTAWDFGSVGGVLNSLGKMVHQIFGSAYTALFSGVSWIMKIGIGVLLTWIGLNSKNTSMSFSCIAIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSASRAWNVWEVEDYGFGVFTTNIWLKLREVYTQSCDHRLMSAAIKDERAVHADMGYWIESQKNGSWKLEKASFIEVKTCTWPKSHTLWSNGVLESDMIIPKSLAGPISQHNHRPGYHTQTAGPWHLGKLELDFNYCEGTTVVITENCGTRGPSLRTTTVSGKLIHEWCCRSCTLPPLRYMGEDGCWYGMEIRPINEKEENMVKSLVSAGSGKVDNFTMGVLCLAILFEEVMRGKFGKKHMIAGVLFTFVLLLSGQITWRDMAHTLIMIGSNASDRMGMGVTYLALIATFKIQPFLALGFFLRKLTSRENLLLGVGLAMATTLQLPEDIEQMANGIALGLMALKLITQFETYQLWTALVSLTCSNTIFTLTVAWRTATLILAGVSLLPVCQSSSMRKTDWLPMAVAAMGVPPLPLFIFSLKDTLKRRSWPLNEGVMAVGLVSILASSLLRNDVPMAGPLVAGGLLIACYVITGTSADLTVEKAADVTWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTHNGKRLEPNWASVKKDLISYGGGWRLSAQWQKGEEVQVIAVEPGKNPKNFQTMPGIFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTAEAFPQSNAPIQDEERDIPERSWNSGNEWITDFVGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGERNNQILEENMDVEIWTKEGERKKLRPRWLDARTYSDPLALKEFKDFAAGRKSIALDLVTEIGRVPSHLAHRTRNALDNLVMLHTSEHGGRAYRHAVEELPETMETLLLLGLMILLTGGAMLFLISGKGIGKTSIGLICVIVSSGMLWMADVPLQWIASAIVLEFFMMVLLIPEPEKQRTPQDNQLAYVVIGILTLAAIVAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLVTHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGETTHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKYGGMLVRNPLSRNSTHEMYWISNGTGNIVSSVNMVSRLLLNRFTMTHRRPTIEKDVDLGAGTRHVNAEPETPNMDVIGERIKRIKEEHSSTWHYDDENPYKTWAYHGSYEVKATGSASSMINGVVKLLTKPWDVVPMVIQMAMTDTTPFGQQRVFKEKVDTRTPRPMPGTRKVMEITAEWLWRTLGRNKRPRLCTREEFTKKVRTNAAMGAVFTEENQWDSARAAVEDEEFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPKGTVMDIISRKDQRGSGQVGTYGLNTFTNMEAQLVRQMEGEGVLSKADLENPHLLEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLKETACLGKAYAQMWSLMYFHRRDLRLASNAICSAVPVHWVPTSRTTWSIHAHHQWMTTEDMLTVWNRVWIEDNPWMEDKTPVTTWEDVPYLGKREDQWCGSLIGLTSRATWAQNILTAIQQVRSLIGDEEFLDYMPSMKRFRKEEESEGAIW

SEQ ID NO: 5117 - protein, 3290 aa, Artificial Sequence
  derived and/or modified protein sequence (wt) from DENV-3__AY858040__SS-prME
TSLCLMMMLPATLAFHLTSRDGEPRMIVGKNERGKSLLFKTASGINMCTLIAMDLGEMCDDTVTYKCPLITEVEPEDIDCWCNLTSTWVTYGTCNQAGEHRRDKRSVALAPHVGMGLDTRAQTWMSAEGAWRQVEKVETWAFRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNVTTDSRCPTQGEAILPEEQDQNYVCKHTYVDRGWGNGCGLFGKGSLVTCAKFQCLELIEGKVVQHENLKYTVIITVHTGDQHQVGNETQGVTAEITPQASTVEAILPEYGTLGLECSPRTGLDFNEMILLTMKNKAWMVHRQWFFDLPLPWTSGATTETPTWNKKELLVTFKNAHAKKQEVVVLGSQEGAMHTALTGATEIQTSGGTSIFAGHLKCRLKMDKLELKGMSYAMCSNAFVLKKEVSETQHGTILIKVEYKGEDAPCKIPFSTEDGQGKAHNGRLITANPVVTKKEEPVNIEAEPPFGESNIIIGIGDKALKINWYKKGSSIGKMFEATARGARRMAILGDTAWDFGSVGGVLNSLGKMVHQIFGSAYTALFSGVSWIMKIGIGVLLTWIGLNSKNTSMSFSCIVIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAEKQNSSFIIDGPNTPECPNASRAWNVWEVEDYGFGVFTTNIWLKLREMYTQLCDHRLMSAAVKDERAVHADMGYWIESQKNGSWKLEKASLIEVKTCTWPKSHTLWSNGVLESDMIIPKSLAGPISQHNYRPGYHTQTAGPWHLGKLELDFNYCEGTTVVITENCGTRGPSLRTTTVSGKLIHEWCCRSCTLPPLRYMGEDGCWYGMEIRPINEKEENMVKSLVSAGSGKVDNFTMGVLCLAILFEEVMRGKFGKKHMIAGVLFTFVLLLSGQITWRDMARTLIMIGSNASDRMGMGVTYLALIATFKIQPFLALGFFLRKLTSRENLLLGVGLAMATTLQLPEDIEQMANGIALGLMALKLITQFETYQLWTALVSLMCSNTIFTLTVAWRTATLILAGISLMPVCQSSSMRKTDWLPMTVAAMGVPPLPLFIFSLKDTLKRRSWPLNEGVMAVGLVSILASSLLRNDVPMAGPLVAGGLLIACYVITGTSADLTVEKAADVTWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTYNGKRLEPNWASVKKDLISYGGGWRLSAYWQKGEEVQVIAVEPGKNPKNFQTMPGIFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPVRYQTTATKSEHTGKEIVDLMCHATFTMRLLSPVRVPNYNLIIMDEAHFTDPASIAARGYISTRVGMGEAAAIFMTATPPGTADAFPQSNAPIQDEERDIPERSWNSGNDWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTVASAAQRRGRVGRNPQKENDQYIFTGQPLNNDEDHAHWTEAKMLLDNINTPEGIIPALFEPEREKSAAIDGEYRPKGESRKTFVELMRRGDLPVWLAHKVASEGIKYTDRKWCFDGERNNQILEENMDVEIWTKEGEKKKLRPRWLDARTYSDPLALKEFKDFAAGRKSIALDLVTEIGRVPSHLAHRTRNALDNLVMLHTSEHGGRAYRHAVEELPETMETLLLLGLMILLTGGAMLFLISGKGVGKTSIGLICVVASSGMLWMADIPLQWIASAIVLEFFMMVLLIPEPEKQRTPQDNQLAYVVIGILTLAAIVAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLVTHYAIIGPGLQAKATREAQKRTAAGIMKNPTVDGIMTIDLDPVIYDSKFEKQLGQVMLLVLCAVQLLLMRTSWAFCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVSSVNMVSRLLLNRFTMTYRRPTIEKDVDLGAGTRHVNAEPETPNMDVIGERIRRIKEEHSSTWHYDDENPYKTWAYHGSYEVKATGSASSMINGVVKLLTKPWDVVPTVTQMAMTDTTPFGQQRVFKEKVDTRTPKPMPGTRKVMEITAEWLWRTLGRNKRPRLCTREEFTKKVRTNAAMGAVFTEENQWDSARAAVEDEEFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMEPEHRQLANAIFKLTYQNKVVKVQRPTPKGTVMDIISRKDQRGSGQVGTYGLNTFTNMEAQLIRQMEGEDVLSKTDLENPHLLEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLKETACLGKAYAQMWALMYFHRRDLRLASNAICSAVPVHWVPTSRTTWSIHAHHQWMTTEDMLTVWNRVWIEDNPWMEDKTPVTTWEDVPYLGKREDQWCGSLIGLTSRATWAQNILTAIQQVRSLIGNEEFLDYMPSMKRFRKEEESEGAIW

SEQ ID NO: 5118 - protein, 3290 aa, Artificial Sequence
  derived and/or modified protein sequence (wt) from DENV-3__AY858041__SS-prME
TSLCLMMMLPATLAFHLTSRDGEPRMIVGKNERGKSLLFKTASGINMCTLIAMDLGEMCDDTVTYKCPLITEVEPEDIDCWCNLTSTWVTYGTCNQAGEHRRDKRSVALAPHVGMGLDTRAQTWMSAEGAWRQVEKVETWAFRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNVTTDSRCPTQGEAILPEEQDQNYVCKHTYVDRGWGNGCGLFGKGSLVTCAKFQCLELIEGKVVQHENLKYTVIITVHTGDQHQVGNETQGVTAEITPQASTVEAILPEYGTLGLECSPRTGLDFNEMILLTMKNKAWMVHRQWFFDLPLPWTSGATTETPTWNKKELLVTFKNAHAKKQEVVVLGSQEGAMHTALTGATEIQTSGGTSIFAGHLKCRLKMDKLELKGMSYAMCSNAFVLKKEVSETQHGTILIKVEYKGEDAPCKIPFSTEDGQGQAHNGRLITANPVVTKKEEPVNIEAESPFGESNIIIGIGDKALKINWYKKGSSIGKMFEATARGARRMAILGDTAWDFGSVGGVLNSLGKMVHQIFGSAYTALFSGVSWIMKIGIGVLLTWIGLNSKNTSMSFSCIVIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAEIQNSSFIIDGPNTPECPNASRAWNVWEVEDYGFGVFTTNIWLKLREMYTQLCDHRLMSAAVKDERAVHADMGYWIESQKNGSWKLEKASLIEVKTCTWPKSHTLWSNGVLESDMIIPKSLAGPISQHNYRPGYHTQTAGPWHLGKLELDFNYCEGTTVVITENCGTRGPSLRTTTVSGKLIHEWCCRSCTLPPLRYMGDDGCWYGMEIRPINEKEENMVKSLVSAGSGKVDNFTMGVLCLAILFEEVMRGKFGKKHMIAGVLFMFVLLLSGQITWRDMARTLIMIGSNASDRMGMGVTYLALIATFKIQPFLALGFFLRKLTSRENLLLGVGLAMATTLQLPEDIEQMANGIALGLMALKLITQFETYQLWTALVSLTCSNTIFTLTVAWRTATLILAGISLLPVCQSSSMRKTDWLPMTVAAMGVPPLPLFIFSLKDTLKRRSWPLNEGVMAVGLVSILASSLLRNDVPMAGPLVAGGLLIACYVITGTSADLTVEKAADVTWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTYNGKRLEPNWASVKKDLISYGGGWRLSAQWKKGEEVQVIAVEPGKNPKNFQTMPGIFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGKEIVDLMCHATFTMRLLSPVRVPNYNLIIMDEAHFTDPASIAARGYISTRVGMGEAAAIFMTATPPGTADAFPQSNAPIQDEERDIPERSWNSGNDWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTVASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGERNNQILEENMDVEIWTKEGEKKKLRPRWLDARTYSDPLALKEFKDFAAGRKSIALDLVTEIGRVPSHLAHRTRNALDNLVMLHTSEHGGRAYRHAVEELPETMETLLLLGLMILLTGGAMLFLISGKGVGKTSIGLICVVASSGMLWMADIPLQWIASAIVLEFFMMVLLIPEPEKQRTPQDNQLAYVVIGILTLAAIVAANEMGLLETTKRDLGMSKEPGVVSSTSYLDVDLHPASAWTLYAVATTVITPMLRHTIENSTANVSLAAIANQAVVLMGLDKGWPISKMDLGVPLLALGCYSQVNPLTLTAAVLLLVTHYAIIGPGLQAKATREAQKRTAAGIMKNPTVDGIMTIDLDPVIYDSKFEKQLGQVMLLVLCAVQLLLMRTSWAFCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVSSVNMVSRLLLNRFTMTYRRPTIEKDVDLGAGTRHVNAEPETPNMDVIGERIRRIKEEHSSTWHYDDENPYKTWAYHGSYEVKATGSASSMINGVVKLLTKPWDVVPTVTQMAMTDTTPFGQQRVFKEKVDTRTPKPMPGTRKVMEITAEWLWRTLGRNKRPRLCTREEFTKKVRTNAAMGAVFTEENQWDSARAAVEDEEFWKLVDRERELHKQGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPKGTVMDIISRKDQRGSGQVGTYGLNTFTNMEAQLIRQMEGEGVLSKTDLENPHLLEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLKETACLGKAYAQMWALMYFHRRDLRLASNAICSAVPVHWVPTSRTTWSIHAHHQWMTTEDMLTVWNRVWIEDNPWMEDKTPVTTWEDVPYLGKREDQWCGSLIGLTSRATWAQNILTAIQQVRSLIGNEEFLDYMPSMKRFRKEEESEGAIW

SEQ ID NO: 5119 - protein, 3290 aa, Artificial Sequence
  derived and/or modified protein sequence (wt) from DENV-3__KC261634__SS-prME
TSICLMMMLPATLAFHLTSRDGEPRMIVGKNERGKSLLFKTASGINMCTLIAMDLGEMCDDTVTYKCPLIAEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNRPTLDIELQKTEATQLATLRKLCIEGKITNITTDSRCPTQGEAVLPEEQDQNYVCKHTYVDRGWGNGCGLFGKGSLVTCAKFQCLEPIEGKVVQYENLKYTVIITVHTGDQHQVGNDTQGVTVEITPQASTVEAVLPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCLNTFVLKKEVSETQHGTILIRVEYKGEDAPCKIPFSTEDGQGKAHNGRLITANPVVTKKEEPVNIEAEPPFGESNIVIGTGDKALKINWYKKGSSIGKMFEATARGARRMAILGDTAWDFGSVGGVLNSLGKMAHQIFGSAYTALFSGVSWIMKIGIGVLLTWIGLNSKNTSMSFSCIVIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAEIQNSSFIIDGPNTPECPSASRAWNVWEVEDYGFGVFTTNIWLKLREVYTQSCDHRLMSAAIKDERAVHADMGYWIESQKNGSWKLEKASFIEVKTCTWPKSHTLWSNGVLESDMIIPKSLAGPISQHNHRPGYHTQTAGPWHLGKLELDFNYCEGTTVVITENCGTRGPSLRTTTVSGKLIHEWCCRSCTLPPLRYMGEDGCWYGMEIRPINEKEENMVKSLVSAGSGKVDNFTMGVLCLAILFEEVMRGKFGKKHMIVGVLFTFVLLLSGQITWRDMTHTLIMIGSNASDRMGMGVTYLALIATFKIQPFLALGFFLRKLTSRENLLLGVGLAMATTLQLPEDIEQMANGIALGLMTLKLITQFETYQLWTALVSLTCSNTIFTLTVAWRTATLILAGVSLLPLCQSSSMRKTDWLPMTVAAMGVPPLPLFIFSLKDAPKKRSWPLNEGVMAVGLVSILASSLLRNDVPMAGPLVAGGLLIACYVITGTSADLTVEKAADVTWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTHNGKRLEPNWASVKKDLISYGGGWRLSAQWQKGEEVQVIAVEPGKNPKNFQTMPGIFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTAEAFPQSNAPIQDEERDIPERSWNSGNEWITDFVGKTVWFVPSIKAGNDIANCLRKNGKKVIQLSRKTFDTEYQKTRLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGERNNQILEENMDVEIWTKEGERKKLRPRWLDARTYSDPLALKEFKDFAAGRKSIALDLVTEIGRVPSHLAHRTRNALDNLVMLHTSEHGGRAYRHAVEELPETMETLLLLGLMILLTGGAMLFLISGKGIGKTSIGLICVIVSSGMLWMADVPLQWIASAIVLEFFMMVLLIPEPEKQRTPQDNQLAYVVIGILTLAAIVAANEMGLLETTKRDLGMSKEPGAVSSTSYLDVDLHPASAWTLYAVATTVITPMLRHTIENSTANVSLAAIANQAVVLMGLDKGWPISKMDLGVPLLALGCYSQVNPLTLTAAVLLLVTHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGRRGTGSQGETLGEKWKKRLNQLSRKEFDLYKKSGITEVDRTEAKEGLKRGETTHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKYGGMLVRNPLSRNSTHEMYWISNGTGNIVSSVNMVSRLLLNRFTMTHRRPTMEKDVDLGAGTRHVNAEPETPNMDVIGERIKRIKEEHSSTWHYDDENPYKTWAYHGSYEVKATGSASSMINGVVKLLTKPWDVVPMVTQMAMTDTTPFGQQRVFKEKVDTRTPRPMPGTRKVMEITAEWLWRTLGRNKKPRLCTREEFTKKVRTNAAMGAVFTEENQWDSARAAVEDEEFWKLVDRERELHRLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRRLASAIFKLTYQNKVVKVQRPTPKGTVMDIISRKDQRGSGQVGTYGLNTFTNMEAQLVRQMEGEGVLSKADLEDPHLLEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLKETACLGKAYAQMWSLMYFHRRDLRLASNAICSAVPVHWVPTSRTTWSIHAHHQWMTTEDMLTVWNRVWIEDNPWMEDKTPVTTWEDVPYLGKREDQWCGSLIGLTSRATWAQNILTAIQQVRSLIGDEEFLDYMPSMKRFRKEEESEGAIW

SEQ ID NO: 5120 - protein, 3290 aa, Artificial Sequence
  derived and/or modified protein sequence (wt) from DENV-3__JN662391__SS-prME
TSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAVLPEEQDQNYVCKHTYVDRGWGNGCGLFGKGSLVTCAKFQCLEPIEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDAPCKIPFSTEDEQGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDTIGVLEQGKRTLTPQPMELKYSWKTWGKAKIVTAETQNSSFIIDGPNTPECPSASRAWNVWEVEDYGFGVFTTNIWLKLREVYTQMCDHRLMSAAVKDERAVHADMGYWIESQKNGSWKLEKASLIEVKTCTWPKSHTLWSNGVLESDMIIPKSLAGPISQHNYRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGKVDNFTMGVLCLAILFEEVMRGKFGKKHMIAGVFLTFMLLLSGQITWRDMAHTLIMIGSNASDRMGMGVTYLALIATFKIQPFLALGFFLRKLTSRENLLLGVGLAMATTIQLPEDIEQMANGIALGLMALKLITQFETYQLWTALISLTCSNTIFTLTVAWRTATLILAGVSLLPVCQSSSMRKTDWLPMTVAAMGVPPLPLFIFSLKDTLKRRSWPLNEGVMAVGLVSILASSLLRNDVPMAGPLVAGGLLIACYVITGTSADLTVEKAADVTWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGILGKTQVGVGVQKEGVFHTMWHVTRGAVLTHNGKRLEPNWASVKKDLISYGGGWRLSAQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTVASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKDFAAGRKSIALDLVTEIGRVPSHLAHRTRNALDNLVMLHTSEHGGRAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLVTHYAIIGPGLQAKATREAQKRTAAGIMKNPTVDGIITIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGETTHHAVSRGSAKLQWFVERNMVIPEGRVIDLGCGRGGWSYYCAGLKKVTEVRGYTKGGPGHEEPVPMSTHGWNIVKLMSGKDVFYLPPEKCDTLLCDIGESSPSPTVEESRTIRVLKMVEPWLKNNQFCIKVLNPYMPAVIEHLERLQRKHGGMLVRNPLSRNSTHEMYWISNGTGNIVSSVNMVSRLLLNRFTMTHRRPTIEKDVDLGAGTRHVNAEPETPNMDVIGERIRRIKEEHNSTWHYDDENPYKTWAYHGSYEVKATGSASSMINGVVKLLTKPWDVVPMVTQMAMTDTTPFGQQRVFKEKVDTRTPRPMPGTRKVMEITAEWLWRTLGRNKRPRLCTREEFTKKVRTNAAMGAVFTEENQWDSAKAAVEDEEFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMNPEHRLLANAIFKLTYQNKVVKVQRPTPTGTVMDIISRKDQRGSGQVGTYGLNTFTNMEAQLVRQMEGEGVLSKADLENPHLPEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLRETACLGKAYAQMWSLMYFHRRDLRLASNAICSAVPVHWVPTSRTTWSIHAHHQWMTTEDMLTVWNRVWIEDNPWMEDKTPVTTWENVPYLGKREDQWCGSLIGLTSRATWAQNISTAIQQVRSLIGNEEFLDYMPSMKRFRKEEESEGAIW

SEQ ID NO: 5121 - protein, 3290 aa, Artificial Sequence
  derived and/or modified protein sequence (wt) from DENV-3__AY858043__SS-prME
TSLCLMMMLPATLAFHLTSRDGEPRMIVGKNERGKSLLFKTASGINMCTLIAMDLGEMCDDTVTYKCPLITEVEPEDIDCWCNLTSTWVTYGTCNQAGEHRRDKRSVALAPHVGMGLDTRAQTWMSAEGAWRQAEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNVTTDSRCPTQGEAILPEEQDQNYVCRHTYVDRGWGNGCGLFGKGSLVTCAKFQCLELIEGKVVQHENLKYTVIITVHTGDQHQVGNETQGVTAEITPQASTVEAILPEYGTLGLECSPRTGLDFNEMILLTMKNKAWMVHRQWFFDLPLPWTSGATTETPTWNKKELLVTFKNAHAKKQEVVVLGSQEGAMHTALTGATEIQTSGGTSIFAGHLKCRLKMDKLELKGMSYAMCSNAFVLKKEVSETQHGTILIKVEYKGEDAPCKIPFSTEDGQGKVHNGRLITANPVVTKKEEPVNIEAEPPFGESNIIIGIGDKALKINWYKKGSSIGKMFEATARGARRMAILGDTAWDFGSVGGVLNSLGKMVHQIFGSAYTALFSGVSWIMKIGIGVLLTWIGLNSKNTSMSFSCIVIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKVVTAEIQNSSFIIDGPNTPECPNASRAWNVWEVEDYGFGVFTTNIWLKLREMYTQLCDHRLMSAAVKDERAVHADMGYWIESQKNGSWKLEKASLIEVKTCTWPKSHTLWSNGVLESDMIIPKSLAGPISQHNYRPGYHTQTAGPWHLGKLELDFNYCEGTTVVITENCGTRGPSLRTTTVSGKLIHEWCCRSCTLPPLRYMGEDGCWYGMEIRPINEKEENMVKSLVSAGSGKVDNFTMGVLCLAILFEEVMRGKFGKKHMIAGVLFMFVLLLSGQITWRDMARTLIMIGSNASDRMGMGVTYLALIATFKIQPFLALGFFLRKLTSRENLLLGVGLAMATTLQLPEDIEQMANGIALGLMALKLITQFETYQLWTALVSLTCSNTIFTLTVAWRTATLILAGISLLPVCQSSSMRKTDWLPMTVAAMGVPPLPLFIFSLKDTLKRRSWPLNEGVMAVGLVSILASSLLRNDVPMAGPLVAGGLLIACYVITGTSADLTVEKAADVTWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTYNGKRLEPNWASVKKDLISYGGGWRLSAQWRKGEEVQVIAVEPGKNPKNFQTMPGIFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGKEIVDLMCHATFTMRLLSPVRVPNYNLIIMDEAHFTDPASIAARGYISTRVGMGEAAAIFMTATPPGTADAFPQSNAPIQDEERDIPERSWNSGNDWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTVASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGERNNQILEENMDVEIWTKEGEKKKLRPRWLDARTYSDPLALKEFKDFAAGRKSIALDLVTEIGRVPSHLAHRTRNALDNLVMLHTSEHGGRAYRHAVEELPETMETFLLLGLMILLTGGAMLFLISGKGVGKTSIGLICVVASSGMLWMADIPLQWIASAIVLEFFMMVLLIPEPEKQRTPQDNQLAYVVIGILTLAAIVAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLVTHYAIIGPGLQAKATREAQKRTAAGIMKNPTVDGIMTIDLDPVIYDSKFEKQLGQVMLLVLCAVQLLLMRTSWAFCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGETTHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVSSVNMVSRLLLNRFTMTYRRPTIEKDVDLGAGTRHVNAEPETPNMDVIGERIRRIKEEHSSTWHYDDENPYKTWAYHGSYEVKATGSASSMINGVVKLLTKPWDVVPTVTQMAMTDTTPFGQQRVFKEKVDTRTPKPMPGTRKVMEITAEWLWRTLGRNKRPRLCTREEFTKKVRTNAAMGAVFTEENQWDSARAAVEDEEFWKLVDRERELHKQGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPKGTVMDIISRKDQRGSGQVGTYGLNTFTNMEAQLIRQMEGEGVLSKTDLENPHLLEKKIIQWLETKGVERLKRMAISGDDCVVKPIDDRFANALLALNDMGKVRKDIPQWQPSRGWHDWQQVPFCSHHFHELIMKDGRKLVVPCRPQDELIGRARISQGAGWSLKETACLGKAYAQMWALMYFHRRDLRLASNAICSAVPVHWVPTSRTTWSIHAHHQWMTTEDMLTVWNRVWIEDNPWMEDKTPVTTWEDVPYLGKREDQWCGSLIGLTSRATWAQNILTAIQQVRSLIGNEEFLDYMPSMKRFRKEEESEGAIW

SEQ ID NO: 5122 - protein, 3290 aa, Artificial Sequence
  derived and/or modified protein sequence (wt) from DENV-3__AY858044__SS-prME
TSLCLMMMLPATLAFHLTSRDGEPRMIVGKNERGKSLLFKTASGINMCTLIAMDLGEMCDDTITYKCPLITEVEPEDIDCWCNLTSTWVTYGTCNQAGEHRRDKRSVALAPHVGMGLDTRAQTWMSAEGAWRQVEKVETWAFRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNVTTDSRCPTQGEAILPEEQDQNYVCKHTYVDRGWGNGCGLFGKGSLVTCAKFQCLELIEGKVVQHENLKYTVIITVHTGDQHQVGNETQGVTAEITPQASTVEAILPEYGTLGLECSPRTGLDFNEMILLTMKNKAWMVHRQWFFDLPLPWTSGATTETPTWNKKELLVTFKNAHAKKQEVVVLGSQEGAMHTALTGATEIQTSGGTSIFAGHLKCRLKMDKLELKGMSYAMCSNAFVLKKEVSETQHGTILIKVEYKGEDAPCKIPFSTEDGQGKAHNGRLITANPVVTKKEEPVNIEAEPPFGESNIIIGIGDKALKINWYKKGSSIGKMFEATARGARRMAILGDTAWDFGSVGGVLNSLGKMVHQIFGSAYTALFSGVSWIMKIGIGVLLTWIGLNSKNTSMSFSCIVIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAEIQNSSFIIDGPNTPECPNASRAWNVWEVEDYGFGVFTTNIWLKLREMYTQLCDHRLMSAAVKDERAVHADMGYWIESQKNGSWKLEKASLIEVKTCTWPKSHTLWSNGVLESDMIIPKSLAGPISQHNYRPGYHTQTAGPWHLGKLELDFNYCEGTTVVITENCGTRGPSLRTTTVSGKLIHEWCCRSCTLPPLRYMGEDGCWYGMEIRPINEKEENMVKSLVSAGSGKVDNFTMGVLCLAILFEEVMRGKFGKKHMIAGVLFMFVLLLSGQITWRDMARTLIMIGSNASDRMGMGVTYLALIATFKIQPFLALGFFLRKLTSRENLLLGVGLAMATTLQLPEDIEQMANGIALGLMALKLITQFETYQLWTALVSLTCSNTIFTLTVAWRTATLILAGISLLPVCQSSSMRKTDWLPMTVAAMGVPPLPLFIFSLKDTLKRRSWPLNEGVMAVGLVSILASSLLRNDVPMAGPLVAGGLLIACYVITGTSADLTVEKAADVTWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTYNGKRLEPNWASVKKDLISYGGGWRLSAQWQKGEEVQVIAVEPGKNPKNFQTMPGIFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGKEIVDLMCHATFTMRLLSPVRVPNYNLIIMDEAHFTDPASIAARGYISTRVGMGEAAAIFMTATPPGTADAFPQSNAPIQDEERDIPERSWNSGNDWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTVASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGERNNQILEENMDVEIWTKEGEKKKLRPRWLDARTYSDPLALKEFKDFAAGRKSIALDLVTEIGRVPSHLAHRTRNALDNLVMLHTSEHGGRAYRHAVEELPETMETLLLLGLMILLTGGAMLFLISGKGVGKTSIGLICVVASSGMLWMADIPLQWIASAIVLEFFMMVLLIPEPEKQRTPQDNQLAYVVIGILTLAAIVAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLVTHYAIIGPGLQAKATREAQKRTAAGIMKNPTVDGIMTIDLDPVIYDSKFEKQLGQVMLLVLCAVQLLLMRTSWAFCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGETTHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVSSVNMVSRLLLNRFTMTYRRPTIEKDVDLGAGTRHVNAEPETPNMDVIGERIRRIKEEHSSTWHYDDENPYKTWAYHGSYEVKATGSASSMINGVVKLLTKPWDVVPTVTQMAMTDTTPFGQQRVFKEKVDTRTPKPMPGTRKVMEITAGWLWRTLGRNKRPRLCTREEFTKKVRTNAAMGAVFTEENQWDSARAAVEDEEFWKLVDRERELHKQGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPKGTVMDIISRKDQRGSGQVGTYGLNTFTNMEAQLIRQMEGEGVLSKTDLENPHLLEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLKETACLGKAYAQMWALMYFHRRDLRLASNAICSAVPVHWVPTSRTTWSIHAHHQWMTTEDMLTVWNRVWIEDNPWMEDKTPVTTWEDVPYLGKREDQWCGSLIGLTSRATWAQNILTAIQQVRSLIGNEEFLDYMPSMKRFRKEEESEGAIW

SEQ ID NO: 5123 - protein, 3290 aa, Artificial Sequence
  derived and/or modified protein sequence (wt) from DENV-3__AY858045__SS-prME
TSLCLMMMLPATLAFHLTSRDGEPRMIVGKNERGKSLLFKTASGINMCTLIAMDLGEMCDDTITYKCPLITEVEPEDIDCWCNLTSTWVTYGTCNQAGEHRRDKRSVALAPHVGMGLDTRAQTWMSAEGAWRQVEKVETWAFRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNVTTDSRCPTQGEAILPEEQDQNYVCKHTYVDRGWGNGCGLFGKGSLVTCAKFQCLELIEGKVVQHENLKYTVIITVHTGDQHQVGNETQGVTAEITPQASTVEAILPEYGTLGLECSPRTGLDFNEMILLTMKNKAWMVHRQWFFDLPLPWTSGATTETPTWNKKELLVTFKNAHAKKQEVVVLGSQEGAMHTALTGATEIQTSGGTSIFAGHLKCRLKMDKLELKGMSYAMCSNAFVLKKEVSETQHGTILIKVEYKGEDAPCKIPFSTEDGQGKAHNGRLITANPVVTKKEEPVNIEAEPPFGESNIIIGIGDKALKINWYKKGSSIGKMFEATARGARRMAILGDTAWDFGSVGGVLNSLGKMVHQIFGSAYTAIFSGVSWIMKIGIGVLLTWIGLNSKNTSMSFSCIVIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAEIQNSSFIIDGPNTPECPNASRAWNVWEVEDYGFGVFTTNIWLKLREMYTQLCDHRLMSAAVKDERAVHADMGYWIESQKNGSWKLEKASLIEVKTCTWPKSHTLWSNGVLESDMIIPKSLAGPISQHNYRPGYHTQTAGPWHLGKLELDFNYCEGTTVVITENCGTRGPSLRTTTVSGKLIHEWCCRSCTLPPLRYMGEDGCWYGMEIRPINEKEENMVKSLVSAGSGKVDNFTMGVLCLAILFEEVMRGKFGKKHMIAGVLFMFVLLLSGQITWRDMARTLIMIGSNASDRMGMGVTYLALIATFEIQPFLALGFFLRKLTSRENLLLGVGLAMATTLQLPEDIEQMANGIALGLMALKLITQFETYQLWTALVSLTCSNTIFTLTVAWRTATLILAGISLLPVCQSSSMRKTDWLPMTVAAMGVPPLPLFIFSLKDTLKRRSWPLNEGVMAVGLVSILASSLLRNDVPMAGPLVAGGLLIACYVITGTSADLTVEKAADVTWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTYNGKRLEPNWASVKKDLISYGGGWRLSAQWQKGEEVQVIAVEPGKNPKNFQTMPGIFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGKEIVDLMCHATFTMRLLSPVRVPNYNLIIMDEAHFTDPASIAARGYISTRVGMGEAAAIFMTATPPGTADAFPQSNAPIQDEERDIPERSWNSGNDWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTVASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGERNNQILEENMDVEIWTKEGEKKKLRPRWLDARTYSDPLALKEFKDFAAGRKSIALDLVTEIGRVPSHLAHRTRNALDNLVMLHTSEHGGRAYRHAVEELPETMETLLLLGLMILLTGGAMLFLISGKGVGKTSIGLICVVASSGMLWMADIPLQWIASAIVLEFFMMVLLIPEPEKQRTPQDNQLAYVVIGILTLAAIVAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLVTHYAIIGPGLQAKATREAQKRTAAGIMKNPTVDGIMTIDLDPVIYDSKFEKQLGQVMLLVLCAVQLLLMRTSWAFCEALTLATGPITTLWEGSPGKFWNTTIAVSMANIFRGSYLAGAGLAFSIMKSVGTGKRGTGSQGETLGEKWKKRLNQLSRKEFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVSSVNMVSRLLLNRFTMTYRRPTIEKDVDLGAGTRHVNAEPETPNMDVIGERIRRIKEEHSSTWHYDDENPYKTWAYHGSYEVKATGSASSMINGVVKLLTKPWDVVPTVTQMAMTDTTPFGQQRVFKEKVDTRTPKPMPGTRKVMEITAGWLWRTLGRNKRPRLCTREEFTKKVRTNAAMGAVFTEENQWDSARAAVEDEEFWKLVDRERELHKQGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPKGTVMDIISRKDQRGSGQVGTYGLNTFTNMEAQLIRQMEGEGVLSKTDLENPHLLEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLKETACLGKAYAQMWALMYFHRRDLRLASNAICSAVPVHWVPTSRTTWSIHAHHQWMTTEDMLTVWNRVWIEDNPWMEDKTPVTTWEDVPYLGKREDQWCGSLIGLTSRATWAQNILTAIQQVRSLIGNEEFLDYMPSMKRFRKEEESEGAIW

SEQ ID NO: 5124 - protein, 3290 aa, Artificial Sequence
  derived and/or modified protein sequence (wt) from DENV-3__AY858046__SS-prME
TSLCLMMMLPATLAFHLTSRDGEPRMIVGKNERGKSLLFKTASGINMCTLIAMDLGEMCDDTITYKCPLITEVEPEDIDCWCNLTSTWVTYGTCNQVGEHRRDKRSVALAPHVGMGLDTRAQTWMSAEGAWRQVEKVETWAFRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNVTTDSRCPTQGEAILPEEQDQNYVCKHTYVDRGWGNGCGLFGKGSLVTCAKFQCLELIEGKVVQHENLKYTVIITVHTGDQHQVGNETQGVTAEITPQASTVEAILPEYGTLGLECSPRTGLDFNEMILLTMKNKAWMVHRQWFFDLPLPWTSGATTETPTWNKKELLVTFKNAHAKKQEVVVLGSQEGAMHTALTGATEIQTSGGTSIFAGHLKCRLKMDKLELKGMSYAMCSNAFVLKKEVSETQHGTILIKVEYKGEDAPCKIPFSTEDGQGKAHNGRLITANPVVTKKEEPVNIEAEPPFGESNIIIGIGDKALKINWYKKGSSIGKMFEATARGARRMAILGDTAWDFGSVGGVLNSLGKMVHQIFGSAYTALFSGVSWIMKIGIGVLLTWIGLNSKNTSMSFSCIVIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAEIQNSSFIIDGPNTPECPNASRAWNVWEVEDYGFGVFTTNIWLKLREMYTQLCDHRLMSAAVKDERAVHADMGYWIESQKNGSWKLEKASLIEVKTCTWPKSHTLWSNGVLESDMIIPKSLAGPISQHNYRPGYHTQTAGPWHLGKLELDFNYCEGTTVVITENCGTRGPSLRTTTVSGKLIHEWCCRSCTLPPLRYMGEDGCWYGMEIRPINEKEENMVKSLVSAGSGKVDNFTMGVLCLAILFEEVMRGKFGKKHMIAGVLFMFVLLLSGQITWRDMARTLIMIGSNASDRMGMGVTYLALIATFKIQPFLALGFFLRKLTSRENLLLGVGLAMATTLQLPEDIEQMANGIALGLMALKLITQFETYQLWTALVSLTCSNTIFTLTVAWRTATLILAGISLLPVCQSSSMRKTDWLPMTVAAMGVPPLPLFIFSLKDTLKRRSWPLNEGVMAVGLVSILASSLLRNDVPMAGPLVAGGLLIACYVITGTSADLTVEKAADVTWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTYNGKRLEPNWASVKKDLISYGGGWRLSAQWQKGEEVQVIAVEPGKNPKNFQTMPGIFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGKEIVDLMCHATFTMRLLSPVRVPNYNLIIMDEAHFTDPASIAARGYISTRVGMGEAAAIFMTATPPGTADAFPQSNAPIQDEERDIPERSWNSGNDWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTVASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGERNNQILEENMDVEIWTKEGEKKKLRPRWLDARTYSDPLALKEFKDFAAGRKSIALDLVTEIGRVPSHLAHRTRNALDNLVMLHTSEHGGRAYRHAVEELPETMETLLLLGLMILLTGGAMLFLISGKGVGKTSIGLICVVASSGMLWMADIPLQWIASAIVLEFFMMVLLIPEPEKQRTPQDNQLAYVVIGILTLAAIVAANEMGMLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLVTHYAIIGPGLQAKATREAQKRTAAGIMKNPTVDGIMTIDLDPVIYDSKFEKQLGQVMLLVLCAVQLLLMRTSWAFCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLRRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVSSVNMVSRLLLNRFTMTYRRPTIEKDVDLGAGTRHVNAEPETPNMDVIGERIRRIKEEHSSTWHYDDENPYKTWAYHGSYEVKATGSASSMINGVVKLLTKPWDVVPTVTQMAMTDTTPFGQQRVFKEKVDTRTPKPMPGTRKAMEITAGWLWRTLGRNKRPRLCTREEFTKKVRTNAAMGAVFTEENQWDSARAAVEDEEFWKLVDRERELHKQGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPKGTVMDIISRKDQRGSGQVGTYGLNTFTNMEVQLIRQMEGEGVLSKTDLENPHLLEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLKETACLGKAYAQMWALMYFHRRDLRLASNAICSAVPVHWVPTSRTTWSIHAHHQWMTTEDMLTVWNRVWIEDNPWMEDKTPVTTWEDVPYLGKREDQWCGSLIGLTSRATWAQNILTAIQQVRSLIGNEEFLDYMPSMKRFRKEEESEGAIW

SEQ ID NO: 5125 - protein, 3290 aa, Artificial Sequence
  derived and/or modified protein sequence (wt) from DENV-3__AY858047__SS-prME
TSLCLMMMLPATLAFHLTSRDGEPRMIVGKNERGKSLLFKTASGINMCTLIAMDLGEMCDDTVTYKCPLITEVEPEDIDCWCNLTSTWVTYGTCNQAGEHRRDKRSVALAPHVGMGLDTRAQTWMSAEGAWRQVEKVETWAFRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNVTTDSRCPTQGEAILPEEQDQNYVCKHTYVDRGWGNGCGLFGKGSLVTCAKFQCLELIEGKVVQHENLKYTVIITVHTGDQHQVGNETQGVTAEITPQASTVEAILPEYGTLGLECSPRTGLDFNEMILLTMKNKAWMVHRQWFFDLPLPWTSGATTETPTWNKKELLVTFKNAHAKKQEVVVLGSQEGAMHTALTGATEIQTSGGTSIFAGHLKCRLKMDKLELKGMSYAMCSNAFVLKKEVSETQHGTILIKVEYKGEDAPCKIPFSTEDGQGKAHNGRLITANPVVTKKEEPVNIEAEPPFGESNIIIGIGDKALKINWYKKGSSIGKMFEATARGARRMAILGDTAWDFGSVGGVLNSLGKMVHQIFGSAYTALFSGVSWIMKIGIGVLLTWIGLNSKNTSMSFSCIVIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDIIGILEQGKRTLTPQPMELKYSWKTWGKAKIVTAEIQNSSFIIDGPNTPECPNASRAWNVWEVEDYGFGVFTTNIWLKLREMYSQLCDHRLMSAAVKDERAVHADMGYWIESQKNGSWKLEKASLIEVKTCTWPKSHTLWSNGVLESDMIIPKSLAGPISQHNYRPGYHTQTAGPWHLGKLELDFNYCEGTTVVITENCGTRGPSLRTTTVSGKLIHEWCCRSCTLPPLRYMGEDGCWYGMEIRPINEKEENMVKSLVSAGSGKVDNFTMGVLCLAILFEEVMRGKFGKKHMIAGVLFTFVLLLSGQITWRDMARTLIMIGSNASDRMGMGVTYLALIATFKIQPFLALGFFLRKLTSRENLLLGVGLAMATTLQLPEDIEQMANGIALGLMALKLITQFETYQLWTALVSLMCSNTIFTLTVAWRTATLILAGISLLPLCQSSSMRKTDWLPMTVAAMGVPPLPLFIFSLKDTLKRRSWPLNEGVMAVGLVSILASSLLRNDVPMAGPLVAGGLLIACYVITGTSADLTVEKAADVTWEEEAEQTGVSHNLMITVDDDGTMRIKDDETENILTVLLKTALLIVSGIFPYSIPATLLVWHTWQKRTQRSGVLWDVPSPPETQKAELEEGVYRIKQQGILGKTQVGVGVQKEGVFHTMWHVTRGAVLTYNGKRLEPNWASVKKDLISYGGGWRLSAQWQKGEEVQVIAVEPGKNPKNFQTMPGIFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGKEIVDLMCHATFTMRLLSPVRVPNYNLIIMDEAHFTDPASIAARGYISTRVGMGEAAAIFMTATPPGTADAFPQSNAPIQDEERDIPERSWNSGNDWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTVASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGERNNQILEENMDVEIWTKEGEKKKLRPRWLDARTYSDPLALKEFKDFAAGRKSIALDLVTEIGRVPSHLAHRTRNALDNLVMLHTSEHGGRAYRHAVEELPETMETLLLLGLMILLTGGVMLFLISGKGVGKTSIGLICVVASSGMLWMADIPLQWIASAIVLEFFMMVLLIPEPEKQRTPQDNQLAYVVIGILTLAAIVAANEMGLLETTKRDLGMSKEPGVASPTSYLDVDLHPASAWTLYAVATTVITPMLRHTIENSTANVSLAAIANQAVVLMGLDKGWPISKMDLGVPLLALGCYSQVNPLTLTAAVLLLVTHYAIIGPGLQAKATREAQKRTAAGIMKNPTVDGIMTIDLDPVIYDSKFEKQLGQVMLLVLCAVQLLLMRTSWAFCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPAVIEHLERLQRKHGGMLVRNPLSRNSTHEMYWISNGTGNIVSSVNMVSRLLLNRFTMTYRRPTIEKDVDLGAGTRHVNAEPETPNMDVIGERIRRIKEEHSSTWHYDDENPYKTWAYHGSYEVKATGSASSMINGVVKLLTKPWDVVPTVTQMAMTDTTPFGQQRVFKEKVDTRTPKPMPGTRKVMEITAEWLWRTLGRNKRPRLCTREEFTKKVRTNAAMGAVFTEENQWDSAKAAVEDEEFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPKGTVMDIISRKDQRGSGQVGTYGLNTFTNMEAQLIRQMEGEGVLSKTDLENPHLLEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLKETACLGKAYAQMWALMYFHRRDLRLASNAICSAVPVHWVPTSRTTWSIHAHHQWMTTEDMLIVWNRVWIEDNPWMEDKTPVTTWEDVPYLGKREDQWCGSLIGLTSRATWAQNILTAIQQVRSLIGNEEFLDYMPSMKRFRKEEESEGAIW

SEQ ID NO: 5126 - protein, 3290 aa, Artificial Sequence
  derived and/or modified protein sequence (wt) from DENV-3__HQ332170__SS-prME
TSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAVLPEEQDQNYVCKHTYVDRGWGNGCGLFGKGSLVTCAKFQCLEPIEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVDYKGEDVPCKIPFSTEDGQGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQADTGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSASRAWNVWEVEDYGFGVFTTNIWLKLREVYTQQCDHRLMSAAVKDERAVHADMGYWIESQKNGSWKLEKASLIEVKTCTWPKSHTLWSNGVLESDMIIPKSLAGPISQHNYRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGEVDNFTMGVLCLAILFEEVMRGKFGKKHMIAGVFFTFVLLLSGQITWRDMAHTLIMIGSNASDRMGMGVTYLALIATFKIQPFLALGFFLRKLTSRENLLLGVGLAMATTLQLPEDIEQMANGIALGLMALKLITQFETYQLWTALISLTCSNTIFTLTVAWRTATLILAGVSLLPVCQSSSMRKTDWLPMTVAAMGVPPLPLFIFSLKDTLKRRSWPLNEGVMAVGLVSILASSLLRNDVPMAGPLVAGGLLIACYVITGTSADLTVEKAADVTWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTYNGKRLEPNWASVKKDLISYGGGWRLSAQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKDFAAGRKSIALDLVTEIGRVPSHLAHRTRNALDNLVMLHTSEHGGKAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGEITHHAVSRGSAKLQWFVERSMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVASVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRSMPGTRRVMGITAEWLWRTLGRNKKPRLCTREEFTKKVRTNAAMGAVFTEENQWDSAKAAVEDEDFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHKQLANAIFKLTYQNKVVKVQRPTPTGTVMDIISRKDQRGSGQVGTYGLNTFTNMEAQLIRQMEGEGVLSKADLENPHLPEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLRETACLGKAYAQMWSLMYFHRRDLRLASNAICSAVPVHWVPTSRTTWSIHAHHQWMTTEDMLTVWNRVWIEDNPWMEDKTPVTTWENVPYLGKREDQWCGSLIGLTSRATWAQNIPTAIQQVRSLIGNEEFLDYMPSMKRFRKEEESEGAIW

SEQ ID NO: 5127 - protein, 3290 aa, Artificial Sequence
  derived and/or modified protein sequence (wt) from DENV-3__AY858038__SS-prME
TSLCLMMMLPATLAFHLTSRDGEPRMIVGKNERGKSLLFKTASGINMCTLIAMDLGEMCDDTVTYKCPLITEVEPEDIDCWCNLTSTWVTYGTCNQAGEHRRDKRSVALAPHVGMGLDTRTQTWMSAEGAWRQVEKVETWAFRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNVTTDSRCPTQGEAILPEEQDQNYVCKHTYVDRGWGNGCGLFGKGSLVTCAKFQCLESIEGKVVQHENLKYTVIITVHTGDQHQVGNETQGVTAEITPQASTVEAILPEYGTLGLECSPRTGLDFNEMILLTMKNKAWMVHRQWFFDLPLPWTSGATTETPTWNKKELLVTFKNAHAKKQEVVVLGSQEGAMHTALTGATEIQTSGGTSIFAGHLKCRLKMDKLELKGMSYAMCLNAFVLKKEVSETQHGTILIKVEYKGEDAPCKIPFSTEDGQGKAHNGRLITANPVVTKKEEPVNIEAEPPFGESNIVIGIGDKALKINWYKKGSSIGKMFEATARGARRMAILGDTAWDFGSVGGVLNSLGKMVHQIFGSAYTALFSGVSWIMKIGIGVLLTWIGLNSKNTSMSFSCIAIGIITLYLGAVVQADMGCVINWKGKELKCGSGIFVTNEVHTWTEQYKFQADSPKRLATAIAGAWENGVCGIRSTTRMENLLWKQIANELNYILWENNIRLTVVVGDTIGVLQQGKRTLPPQPMELKYSWKTWGKAKIVTAKTQNSSFIIDGPNTPEWPSASRAWNVWEVEDYGFGVFTTNIWLKLREMYTQLCDHRLMSAAVKDERAVHADMGYWIESQKNGSWKLEKASLIEVKTCTWPKSHTLWSNGVLESDMIIPKSLAGPISQHNYRPGYHTQTAGPWHLGKLELDFNYCEGTTVVITENCGTRGPSLRTTTVSGKLIHEWCCRSCTLPPLRYMGEDGCWYGMEIRPINEKEENMVKSLVSAGSGKVDNFTMGVLCLAILFEEVMRGKFGKKHMIAGVLFTFVLLLSGQITWRDMARTLIMIGSNASDRMGMGVTYLALIATFKIQPFLALGFFLRKLTSRENLLLGVGLAMATTLQLPEDIEQMANGIALGLMALKLVTQFETYQLWTALVSLMCSNTIFTLTVAWRTATLILAGISLLPVCQSSSMRKTDWLPMTVAAMGVPPLPLFIFSLKDTLKRRSWPLNEGVMAVGLVSILASSLLRNDVPMAGPLVAGGLLIACYVITGTSADLTVEKAADVIWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTHNGKRLEPNWASVKKDLISYGGGWRLSAQWQKGEEVQVIAVEPGKNPKNFQTMPGIFQTTTGEIGAIALDFKPGTSGSPIINREGKVVGLYGNGVVTKNGGYVSGIAQTNAEPDGPTPELEEEMFKKRNLTIMDLHPGSGKTRKYLPAIIREAIKRRLRTLILAPTRVVAAEMEEALKGLPIRYQTTATKSEHTGKEIVDLMCHATFTMRLLSPVRVPNYNLIIMDEAHFTDPASIAARGYISTRVGMGEAAAIFMTATPPGTADAFPQSNAPIQDEERDIPERSWNSGNDWITDFAGKTVWFVPSIKAGNDIANCLRKNGKKVIQLSRKTFDTEYQRTKLNDWDFVVTTDISEMGANFKADRVIDPRRCLKPVILTDGPERVILAGPMPVTVASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGERNNQILEENMDVEIWTKEGEKKKLRPRWLDARTYSDPLALKEFKDFAAGRKSIALDLVTEIGRVPSHLAHRTRNALDNLVMLHTSEHGGRAYRHAVEELPETMETLLLLGLMILLTGGAMLFLISGKGIGKTSIGLICVVASSGMLWMADVPLQWIASAIVLEFFMMVLLIPEPEKQRTPQDNQLAYVVIGILTLAAIVAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLVTHYAIIGPGLQAKATREAQKRTAAGIMKNPTVDGIMTIDLDPVIYDSKFEKQLGQVMLLVLCAVQLLLMRTSWAFCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVSSVNMVSRLLLNRFTMTHRRPTIEKDVDLGAGTRHVNAEPETPNMDVIGERIRRIKEEHSSTWHYDDENPYKTWAYHGSYEVKATGSASSMINGVVKLLTKPWDVVPTVTQMAMTDTTPFGQQRVFKEKVDTRTPRPMPGTRKVMEITAEWLWRTLGRNKRPRLCTREEFTKKVRTNAAMGAVFTEENQWDSARAAVEDEEFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPKGTVMDIISRKDQRGSGQVGTYGLNTFTNMEAQLIRQMEGEGVLSKADLENPHLLEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLKETACLGKAYAQMWALMYFHRRDLRLASNAICSAVPVHWVPTSRTTWSIHAHHQWMTTEDMLTVWNRVWIEDNPWMEDKTPVTTWEDVPYLGKREDQWCGSLIGLTSRATWAQNILTAIQQVRSLIGNEEFLDYMPSMKRFRKEEESEGAIW

SEQ ID NO: 5128 - protein, 3290 aa, Artificial Sequence
  derived and/or modified protein sequence (wt) from DENV-3__AY858039__SS-prME
TSLCLMMMLPATLAFHLTSRDGEPRMIVGKNERGKSLLFKTASGINMCTLIAMDLGEMCDDTVTYKCPLITEVEPEDIDCWCNLTSTWVTYGTCNQAGEHRRDKRSVALAPHVGMGLDTRAQTWMSAEGAWRQVEKVETWAFRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNVTTDSRCPTQGEAILPEEQDQNYVCKHTYVDRGWGNGCGLFGKGSLVTCAKFQCLELIEGKVVQHENLKYTVIITVHTGDQHQVGNETQGVTAEITPQASTVEAILPEYGTLGLECSPRTGLDFNEMILLTMKNKAWMVHRQWFFDLPLPWTSGATTETPTWNKKELLVTFKNAHAKKQEVVVLGSQEGAMHTALTGATEIQTSGGTSIFAGHLKCRLKMDKLELKGMSYAMCSNAFVLKKEVSETQHGTILIKVEYKGEDAPCKIPFSTEDGQGKAHNGRLITANPVVTKKEEPVNIEAEPPFGESNIIIGIGDKALKINWYKKGSSIGKMFEATARGARRMAILGDTAWDFGSVGGVLNSLGKMVHQIFGSAYTALFSGVSWIMKIGIGVLLTWIGLNSKNTSMSFSCIVIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAEIQNSSFIIDGPNTPECPNASRAWNVWEVEDYGFGVFTTNIWLKLREMYTQLCDHRLMSAAVKDERAVHADMGYWIESQKNGSWKLEKASLIEVKTCTWPKSHTLWSNGVLESDMIIPKSLAGPISQHNYRPGYHTQTAGPWHLGKLELDFNYCEGTTVVITENCGTRGPSLRTTTVSGKLIHEWCCRSCTLPPLRYMGEDGCWYGMEIRPINEKEENMVKSLVSAGSGKVDNFTMGVLCLAILFEEVMRGKFGKKHMIAGVLFIFVLLLSGQITWRDMARTLIMIGSNASDRMGMGVTYLALIATFKIQPFLALGFFLRKLTSRENLLLGVGLAMATTLQLPEDIEQMANGIALGLMALKLITQFETYQLWTALVSLTCSNTIFTLTVAWRTATLILAGISLLPVCQSSSMRKTDWLPMTVAAMGVPPSPLFIFSLKDTLKRRSWPLNEGVMAVGLVSILASSLLRNDVPMAGPLVAGGLLIACYVITGTSADLTVEKAADVTWEEEAEQTGVSHNLMITVDDDGTMRIKDDETENILTVLLKTALLIVSGIFPYSIPATLLVWHTWQKQTQRSGVLWDVPSPPETQKAELEEGVYRIKQRGIFGKTQVGVGVQKEGVFHTMWHVTRGAVLTYNGKRLEPNWASVKKDLISYGGGWRLSAQWQKGEEVQVIAVEPGKNPKNFQTMPGIFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGKEIVDLMCHATFTMRLLSPVRVPNYNLIIMDEAHFTDPASIAARGYISTRVGMGEAAAIFMTATPPGTADAFPQSNAPIQDEERDIPERSWNSGNDWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTVASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGERNNQILEENMDVEIWTKEGEKKKLRPRWLDARTYSDPLALKEFKDFAAGRKSIALDLVTEIGRVPSHLAHRTRNALDNLVMLHTSEHGGRAYRHAVEELPETMETLLLLGLMILLTGGAMLFLISGKGVGKTSIGLICVVASSGMLWMADIPLQWIASAIVLEFFMMVLLIPEPEKQRTPQDNQLAYVVIGILTLAAIVAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLVTHYAIIGPGLQAKATREAQKRTAAGIMKNPTVDGIMTIDLDPVIYDSKFEKQLGQVMLLVLCAVQLLLMRTSWAFCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVSSVNMVSRLLLNRFTMTYRRPTIEKDVDLGAGTRHVNAEPETPNMDVIGERIRRIKEEHSSTWHYDDENPYKTWAYHGSYEVKATGSASSMINGVVKLLTKPWDVVPTVTQMAMTDTTPFGQQRVFKEKVDTRTPKPMPGTRKVMEITAEWLWRTLGRNKRPRLCTREEFTKKVRTNAAMGAVFTEENQWDSARAAVEDEEFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPKGTVMDIISRKDQRGSGQVGTYGLNTFTNMEAQLIRQMEGEGVLSKTDLENPHLLEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLKETACLGKAYAQMWALMYFHRRDLRLASNAICSAVPVHWVPTSRTTWSIHAHHQWMTTEDMLTVWNRVWIEDNPWMEDKTPVTTWEDVPYLGKREDQWCGSLIGLTSRATWAQNILTAIQQVRSLIGNEEFLDYMPSMKRFRKEEESEGAIW

SEQ ID NO: 5129 - protein, 3290 aa, Artificial Sequence
  derived and/or modified protein sequence (wt) from DENV-3__JN368477__SS-prME
TSLCLMMMLPATLAFHLTSRDGEPRMIVGKNERGKSLLFKTASGINMCTLIAMDLGEMCDDTVTYKCPLIAEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKSKPTLDIELQKTEATQLATLRKLCIEGKITNITTDSRCPTQGEATLPEEQDQNYVCKHTYVDRGWGNGCGLFGKGSLVTCAKFQCLEPIEGKVVQYENLKYTVIITVHTGDQHQVGNDTQGVTVEITPQASTVEAVLPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCLNTFVLKKEVSETQHGTILIKVEYKGEDAPCKIPFSTEDGQGKAHNGRLITANPVVTKKEEPVNIEAEPPFGESNIVIGIGDKALKINWYKKGSSIGKMFEATARGARRMAILGDTAWDFGSVGGVLNSLGKMVHQIFGSAYTALFSGVSWIMKIGIGVLLTWIGLNSKNTSMSFSCIVIGIITLYLGAVVQADMGCVINWKGKELKCGNGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSASRAWNVWEVEDYGFGVFTTNIWLKLREVYTQSCDHRLMSAAIKDERAVHADMGYWIESQKNGSWKLEKASFIEVKTCTWPKSHTLWSNGVLESDMIIPKSLAGPISQHNHRPGYHTQTAGPWHLGKLELDFNYCEGTTVVIAENCGTRGPSLRTTTVSGKLIHEWCCRSCTLPPLRYMGEDGCWYGMEIRPINEKEENMVKSLVSAGSGKVDNFTMGVLCLAILFEEVMRGKFGKKHMIAGVLFTFVLLLSGQITWRDMAHTLIMIGSNASDRMGMGVTHLALIATFKIQPFLALGFFLRKLTSRENLLLGVGLAMATTLQLPEDIEQMANGIALGLMTLKLITQFETYQLWTALVSLTCSNTIFTLTVAWRTATLILAGVSLLPLCQSSSMRKTDWLPMTVAAMGVPPLPLFIFSLKDTPKRRSWPLNEGVMAVGLVSILASSLLRNDVPMAGPLVAGGLLIACYVITGTSADLTVEKAADVTWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTHNGKRLEPNWASVKKDLISYGGGWRLSAQWQKGEEVQVIAVEPGKNPKNFQTMPGIFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLVIMDEAHFTDPASIAARGYISTRVGMGEAAAIFMTATPPGTAEAFPQSNAPIQDEERDIPERSWNSGNEWITDFVGKTVWFVPSIKAGNDIANCLRKNGKKVIQLSRKTFDTEYQKTRLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGERNNQILEENMDVEIWTKEGERKKLRPRWLDARTYSDPLALKEFKDFAAGRKSIALDLVTEIGRVPSHLAHRTRNALDNLVMLHTSEHGGRAYRHAVEELPETMETLLLLGLMILLTGGAMLFLISGKGIGKTSIGLICVIVSSGMLWMADVPLQWIASAIVLEFFMMVLLIPEPEKQRTPQDNQLAYVVIGILTLAAIVAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLVTHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGRRGTGSQGETLGEKWKKKLNQLSRKEFDLYKKSGITEVDRTEAKEGLKRGETTHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLRNNQFCIKVLNPYMPTVIEHLERLQRKYGGMLVRNPLSRNSTHEMYWISNGTGNIVSSVNMVSRLLLNRFTMTHRRPTIEKDVDLGAGTRHVNAEPETPNMDVIGERIKRIKEEHSSTWHYDDENPYKTWAYHGSYEVKATGSASSMINGVVKLLTKPWDVVPMVTQMAMTDTTPFGQQRVFKEKVDTRTPRPMPGTRKVMEITAEWLWRTLGRNKKPRLCTREEFTKKVRTNAAMGAVFTEENQWDSARAAVEDEEFWKLVDKERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPGHRQLANAIFKLTYQNKVVKVQRPTPKGTVMDIISRKDQRGSGQVGTYGLNTFTNMEAQLVRQMEGEGVLSKADLENPHLLEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLKETACLGKAYAQMWSLMYFHRRDLRLASNAICSAVPVHWIPTSRTTWSIHAHHQWMTTEDMLTVWNRVWIEDNPWMEDKTPVTTWEDVPYLGKREDQWCGSLIGLTSRATWAQNILTAIQQVRSLIGDEEFLDYMPSMKRFRKEEETEGAIW

SEQ ID NO: 5130 - protein, 3290 aa, Artificial Sequence
  derived and/or modified protein sequence (wt) from DENV-3__EF643017__SS-prME
TSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGERRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAVLPEEQDQNYVCKHTYVDRGWGNGCGLFGKGSLVTCAKFQCLEPIEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFSGHLKCRLKMDKLELKGMSYAMCTNTFVLKKEVSETQHGTILIKVEYRGEDAPCKIPFSTEDGQGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSASRAWNVWEVEDYGFGVFTTNIWLKLREVYTQLCDHRLMSAAVKDERAVHADMGYWIESQKNGSWKLEKASLIEVKTCTWPKSHTLWSNGVLESDMITPKSLAGPISQHNHRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGKVDNFTMGVLCLAILFEEVMRGKFGKKHMIAGVFFTFVLLLSGQITWRDMTHTLIMIGSNASDRMGMGVTYLALIATFKIQPFLALGFFLRKLTSRENLLLGVGLAMATTLQLPEDIEQMANGIALGLMALKLITQFETYQLWTALISLTCSNTMFTLTVAWRTATLILAGVSLLPVCQSSSMRKTDWLPMAVAAMGVSPLPLFIFSLKDTLKRRSWPLNEGVMAVGLVSILASSLLRNDVPMAGPLVAGGLLIACYVITGTSADLTVEKAADITREEEAEQTGVSHNLMTTVDDDGTMRIKDDETENILTVLLKTALLIVSGVFPYSIPATLLVWHTWQKQTQRSGVLWDVPSPPETQKAELEEGVYRIKQQGIFGKTQVGVGVQKEGVFHTMWHVTRGAVLTYNGKRLEPNWASVKKDLISYGGGWRLSAQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKDFAAGRKSIALDLVTEIGRVPSHLAHRTRNALDNLVMLHTSEHGGRAYRHAVEELPETMETLLLLGLMILLTGGAMLFLISGKGIGKTSIGLICVIASSGMSWMAEIPLQWIASAIVLEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGVGLAFSIMKSVGTGKRGTGSQGETLGEKWKKKLNQLSRKEFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVASVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRSMPGTRRVMGITAEWLWRTLGRNKKPRLCTREEFTKKVRTNAAMGAVFTEENQWDSAKAAVEDEDFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPTGTVMDIISRKDQRGSGQVGTYGLNTFTNMEAQLIRQMEGEGVLSKADLENPHLPEKKITQWLETKGVERLKRMAISGDDCVVKPIDDRFANALLALNDTGKVRKDIPQWQPSKGWHDWQQVPFCSHHFHELIMKDGRKLVVPCRPQDELIGRARISQGAGWSLRETACLGKAYAQMWSLMYFHRRDLRLASNAICSAVPVHWVPTSRTTWSIHAHHQWMTTEDMLTVWNRVWIEDNPWMEDKTPVTTWENVPYLGKREDQWCGSLIGLTSRATWAQNIPTAIQQVRSLIGNEEFLDYMPSMKRFRKEEESEGAIW

SEQ ID NO: 5131 - protein, 3290 aa, Artificial Sequence
  derived and/or modified protein sequence (wt) from DENV-3__DQ675519__SS-prME
TSICLMMMLPATLAFHLTSRDGEPRMIVGKNERGKSLLFKTASGINMCTLIAMDLGEMCDDTVTYKCPLITEVEPEDIDCWCNLTSTWVTYGTCNQAGEHRRDKRSVALAPHVGMGLDTRTQTWMSAEGAWRQVEKVETWAFRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNVTTDSRCPTQGEAILPEEQDQNYVCKHTYVDRGWGNGCGLFGKGSLVTCAKFQCLESIEGKVVQHENLKYTVIITVHTGDQHQVGNETQGVTAEITPQASTVEAILPEYGTLGLECSPRTGLDFNEMILLTMKNKAWMVHRQWFFDLPLPWTSGATTETPTWNKKELLVTFKNAHAKKQEVVVLGSQEGAMHTALTGATEIQTSGGTSIFAGHLKCRLKMDKLELKGMSYAMCLNAFVLKKEVSETQHGTILIKVEYKGEDAPCRIPFSTEDGQGKAHNGRLITANPVVTKKEEPVNIEAEPPFGESNIVIGIGDKALKINWYKKGSSIGKMFEATARGARRMAILGDTAWDFGSVGGVLNSLGKMVHQIFGSAYTALFSGVSWIMKIGIGVLLTWIGLNSKNTSMSFSCIVIGIITLYLGAVVQADMGCVINWKGKELKCGNGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSASRAWNVWEVEDYGFGVFTTNIWLKLREVYTQLCDHRLMSAAVKDERAVHADMGYWIESQKNGSWKLEKASLIEVKTCTWPKSHTLWSNGVLESDMIIPKSLAGPISQHNHRPGYHTQTAGPWHLGKLELDFNYCEGTTVVITENCGTRGPSLRTTTVSGKLIHEWCCRSCTLPPLRYMGEDGCWYGMEIRPINEKEENMVKSLVSAGSGKVDNFTMGVLCLAILFEEVMRGKFGKKHMIAGVLFTFVLLLSGQITWRDMAHTLIMIGSNASDRMGMGVTYLALIATFKIQPFLALGFFLRKLTSRENLLLGVGLAMATTLQLPEDIEQMANGVALGLMALKLITQFETYQLWTALVSLMCSNTIFTLTVAWRTATLILAGISLLPVCQSSSMRKTDWLPMTVAAMGVPPLPLFIFSLKDTLKRRSWPLNEGVMAIGLVSILASSLLRNDVPMAGPLVAGGLLIACYVITGTSADLTVEKAADVTWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGIQKEGVFHTMWHVTRGAVLTHNGKRLEPNWASVKKDLISYGGGWRLSAQWQKGEEVQVIAVEPGKNPKNFQTMPGIFQTTTGEIGAIALDFKPGTSGSPIINREGKVVGLYGNGVVTKNGGYVSGIAQTNAEPDGPTPELEEEMFKKRNLTIMDLHPGSGKTRKYLPTIVREAIKRRLRTLILAPTRVVAAEMEEALKGLPIRYQTTATKSEHTGKEIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFVGKTVWFVPSIKAGNDIANCLRKNGKKVIQLSRKTFDTEYQKTKLNDWDFVVTTDISEMGANFKADRVIDPRRCLKPVILTDGPERVILAGPMPVTVASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGERNNQILEENMDVEIWTKEGEKKKLRPRWLDARTYSDPLALKEFKDFAAGRKSIALDLVTEIGRVPSHLAYRTRSALDNLVMLHTSEHGGRAYRHAVEELPETMETLLLLGLMILLTGGAMLFLISGKGIGKTSIGLICVVASSGMLWMADVPLQWIASAIVLEFFMMVLLIPEPEKQRTPQDNQLAYVVIGILTLAAIVAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLVTHYAIIGPGLQAKATREAQKRTAAGIMKNPTVDGIMTIDLDPVIYDSKFEKQLGQVMLLVLCAVQLLLMRTSWAFCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTKAKEGLKRGETTHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVSSVNMVSRLLLNRFTMTHRRPTIEKDVDLGAGTRHVNAEPETPNMDVIGERIRRIKEEHSSTWHYDDENPYKTWAYHGSYEVKATGSASSMINGVVKLLTKPWDVVPTVTQMAMTDTTPFGQQRVFKEKVDTRTPRPMPGTRKVMEITAEWLWRTLGRNKRPRLCTREEFTKKVRTNAAMGAVFTEENQWDSARAAVEDEEFWKLVDRERELHKLGKCGSCVYNMMGKREKKLGEFGKAKGSRAIWYMWLGARYLEFEALGFLNEDHWFSRENSYSGVEGEGLHKLGYILRDISKTPGGAMYADDTAGWDTRITEDDLHNEEKITQQMDPEHRQLANAIFKLTYQNKVVKVQRPTPKGTVMDIISRKDQRGSGQVGTYGLNTFTNMEAQLIRQMEGEGVLSKADLENPHLPEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLKETACLGKAYAQMWSLMYFHRRDLRLASNAICSAVPVHWVPTSRTTWSIHAHHQWMTTEDMLTVWNRVWIEDNPWMEDKTPVTTWEDVPYLGKREDQWCGSLIGLTSRATWAQNILTAIQQVRSLIGNEEFLDYMPSMKRFRKEEESEGAIW

SEQ ID NO: 5132 - protein, 3290 aa, Artificial Sequence
  derived and/or modified protein sequence (wt) from DENV-3__DQ675521__SS-prME
TSFCLMMMLPATLAFHLTSRDGEPRMIVGKNERGKSLLFKTASGINMCTLIAMDLGEMCDDTVTYKCPLIAEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAILPEEQDQNYVCKHTYVDRGWGNGCGLFGKGSLVTCAKFQCLEPIEGKVVQYENLKYTVIITVHTGDQHQVGNDTQGVTVEITPQASTVEAVLPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCLNTFVLKKEVSETQHGTILIKVEYKGEDAPCKIPFSTEDGQGKAHNGRLITANPVVTKKEEPVNIEAEPPFGESNIVIGIGDKALKINWYKKGSSIGKMFEATARGARRMAILGDTAWDFGSVGGVLNSLGKMVHQIFGSAYTALFSGVSWIMKIGIGVLLTWIGLNSKNTSMSFSCIVIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAEIQNSSFIIDGPNTPECPSASRAWNVWEVEDYGFGVFTTNIWLKLREMYTQSCDHRLMSAAIKDERAVHADMGYWIESQKNGSWKLEKASFIEVKTCTWPKSHTLWSNGVLESDMIIPKSLAGPISQHNHRPGYHTQTAGPWHLGKLELDFNYCEGTTVVITENCGTRGPSLRTTTVSGKLIHEWCCRSCTLPPLRYMGEDGCWYGMEIRPINEKEENMVKSLVSAGSGKVDNFTMGVLCLAILFEEVMRGKFGKKHMIVGVLFTFVLLLSGQITWRDMAHTLIMIGSNASDRMGMGVTYLALIATFKIQPFLALGFFLRKLTSRENLLLGVGLAMATTLQLPEDIEQMANGIALGLMTLKLITQFETYQLWTALVSLTCSNTIFTLTVAWRTATLILAGVSLLPLCQSSSMRKTDWLPMTVAAMGVPPLPLFIFSLKDTPKRRSWPLNEGVMAVGLVSILASSLLRNDVPMAGPLVAGGLLIACYVITGTSADLTVEKAADVTWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTHNGKRLEPNWASVKKDLISYGGGWRLSAQWQKGEEVQVIAVEPGKNPKNFQTMPGIFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTAEAFPQSNAPIQDEERDIPERSWNSGNEWITDFVGKTVWFVPSIKAGNDIANCLRKNGKKVIQLSRKTFDTEYQKTRLNDWDFVVTTDISEMGANFRADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGERNNQILEENMDVEIWTKEGERKKLRPRWLDARTYSDPLALKEFKDFAAGRKSIALDLVTEIGRVPSHLAHRTRNALDNLVMLHTSEHGGRAYRHAVEELPETMETLLLLGLMILLTGGAMLFLISGKGIGKTSIGLICVIVSSGMLWMADVPLQWIASAIVLEFFMMVLLIPEPEKQRTPQDNQLAYVVIGILTLAAIVAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLVTHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGRRGTGSQGETLGEKWKKKLNQLSRKEFDLYKKSGITEVDRTEAKEGLKRGETTHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKYGGMLVRNPLSRNSTHEMYWISNGTGNIVSSVNMVSRLLLNRFTMTHRRPTIEKDVDLGAGTRHVNAEPETPNMDVIGERIKRIKEEHSSTWHYDDENPYKTWAYHGSYEVKATGSASSMINGVVKLLTKPWDVVPMVTQMAMTDTTPFGQQRVFKEKVDTRTPRPMPGTRKVMEITAEWLWRTLGRNKKPRLCTREEFTKKVRTNAAMGAVFTEENQWDSARAAVEDEEFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLASAIFKLTYQNKVVKVQRPTPKGTVMDIISRKDQRGSGQVGTYGLNTFTNMEAQLVRQMEGEGVLSKADLENPHLLEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLKETACLGKAYAQMWSLMYFHRRDLRLASNAICSAVPVHWVPTSRTTWSIHAHHQWMTTEDMLTVWNRVWIEDNPWMEDKTPVTTWEDVPYLGKREDQWCGSLIGLTSRATWAQNILTAIQQVRSLIGDEEFLDYMPSMKRFRKEEESEGAIW

SEQ ID NO: 5133 - protein, 3290 aa, Artificial Sequence
  derived and/or modified protein sequence (wt) from DENV-3__DQ675522__SS-prME
TSFCLMMMLPATLAFHLTSRDGEPRMIVGKNERGKSLLFKTASGINMCTLIAMDLGEMCDDTVTYKCPLIAEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAILPEEQDQNYVCKHTYVDRGWGNGCGLFGKGSLVTCAKFQCLEPIEGKVVQYENLKYTVIITVHTGDQHQVGNDTQGVTVEITPQASTVEAVLPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCLNTFVLKKEVSETQHGTILIKVEYKGEDAPCKIPFSTEDGQGKAHNGRLITANPVVTKKEEPVNIEAEPPFGESNIVIGIGDKALKINWYKKGSSIGKMFEATARGARRMAILGDTAWDFGSVGGVLNSLGKMVHQIFGSAYTALFSGVSWIMKIGIGVLLTWIGLNSKNTSMSFSCIVIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAEIQNSSFIIDGPNTPECPSASRAWNVWEVEDYGFGVFTTNIWLKLREMYTQSCDHRLMSAAIKDERAVHADMGYWIESQKNGSWKLEKASFIEVKTCTWPKSHTLWSNGVLESDMIIPKSLAGPISQHNHRPGYHTQTAGPWHLGKLELDFNYCEGTTVVITENCGTRGPSLRTTTVSGKLIHEWCCRSCTLPPLRYMGEDGCWYGMEIRPINEKEENMVKSLVSAGSGKVDNFTMGVLCLAILFEEVMRGKFGKKHMIVGVLFTFVLLLSGQITWRDMAHTLIMIGSNASDRMGMGVTYLALIATFKIQPFLALGFFLRKLTSRENLLLGVGLAMATTLQLPEDIEQMANGIALGLMTLKLITQFETYQLWTALVSLTCSNTIFTLTVAWRTATLILAGVSLLPLCQSSSMRKTDWLPMTVAAMGVPPLPLFIFSLKDTPKRRSWPLNEGVMAVGLVSILASSLLRNDVPMAGPLVAGGLLIACYVITGTSADLTVEKAADVTWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTHNGKRLEPNWASVKKDLISYGGGWRLSAQWQKGEEVQVIAVEPGKNPKNFQTMPGIFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTAEAFPQSNAPIQDEERDIPERSWNSGNEWITDFVGKTVWFVPSIKAGNDIANCLRKNGKKVIQLSRKTFDTEYQKTRLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGERNNQILEENMDVEIWTKEGERKKLRPRWLDARTYSDPLALKEFKDFAAGRKSIALDLVTEIGRVPSHLAHRTRNALDNLVMLHTSEHGGRAYRHAVEELPETMETLLLLGLMILLTGGAMLFLISGKGIGKTSIGLICVIVSSGMLWMADVPLQWIASAIVLEFFMMVLLIPEPEKQRTPQDNQLAYVVIGILTLAAIVAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLVTHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGRRGTGSQGETLGEKWKKKLNQLSRKEFDLYKKSGITEVDRTEAKEGLKRGETTHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKYGGMLVRNPLSRNSTHEMYWISNGTGNIVSSVNMVSRLLLNRFTMTHRRPTIEKDVDLGAGTRHVNAEPETPNMDVIGERIKRIKEEHSSTWHYDDENPYKTWAYHGSYEVKATGSASSMINGVVKLLTKPWDVVPMVTQMAMTDTTPFGQQRVFKEKVDTRTPRPMPGTRKVMEITAEWLWRTLGRNKKPRLCTREEFTKKVRTNAAMGAVFTEENQWDSARAAVEDEEFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLASAIFKLTYQNKVVKVQRPTPKGTVMDIISRKDQRGSGQVGTYGLNTFTNMEAQLVRQMEGEGVLSKADLENPHLLEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLKETACLGKAYAQMWSLMYFHRRDLRLASNAICSAVPVHWVPTSRTTWSIHAHHQWMTTEDMLTVWNRVWIEDNPWMEDKTPVTTWEDVPYLGKREDQWCGSLIGLTSRATWAQNILTAIQQVRSLIGDEEFLDYMPSMKRFRKEEESEGAIW

SEQ ID NO: 5134 - protein, 3290 aa, Artificial Sequence
  derived and/or modified protein sequence (wt) from DENV-3__DQ675527__SS-prME
TSFCLMMMLPATLAFHLTSRDGEPRMIVGKNERGKSLLFKTASGINMCTLIAMDLGEMCDDTVTYKCPLIAEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAILPEEQDQNYVCKHTYVDRGWGNGCGLFGKGSLVTCAKFQCLEPIEGKVVQYENLKYTVIITVHTGDQHQVGNDTQGVTVEITPQASTVEAVLPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCLNTFVLKKEVSETQHGTILIKVEYKGEDAPCKIPFSTEDGQGKAHNGRLITANPVVTKKEEPVNIEAEPPFGESNIVIGIGDKALKINWYKKGSSIGKMFEATARGARRMAILGDTAWDFGSVGGVLNSLGKMVHQIFGSAYTALFSGVSWIMKIGIGVLLTWIGLNSKNTSMSFSCIVIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAEIQNSSFIIDGPNTPECPSASRAWNVWEVEDYGFGVFTTNIWLKLREMYTQSCDHRLMSAAIKDERAVHADMGYWIESQKNGSWKLEKASFIEVKTCTWPKSHTLWSNGVLESDMIIPKSLAGPISQHNHRPGYHTQTAGPWHLGKLELDFNYCEGTTVVITENCGTRGPSLRTTTVSGKLIHEWCCRSCTLPPLRYMGEDGCWYGMEIRPINEKEENMVKSLVSAGSGKVDNFTMGVLCLAILFEEVMRGKFGKKHMIVGVLFTFVLLLSGQITWRDMAHTLIMIGSNASDRMGMGVTYLALIATFKIQPFLALGFFLRKLTSRENLLLGVGLAMATTLQLPEDIEQMANGIALGLMTLKLITQFETYQLWTALVSLTCSNTIFTLTVAWRTATLILAGVSLLPLCQSSSMRKTDWLPMTVAAMGVPPLPLFIFSLKDTPKRRSWPLNEGVMAVGLVSILASSLLRNDVPMAGPLVAGGLLIACYVITGTSADLTVEKAADVTWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTHNGKRLEPNWASVKKDLISYGGGWRLSAQWQKGEEVQVIAVEPGKNPKNFQTMPGIFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTAEAFPQSNAPIQDEERDIPERSWNSGNEWITDFVGKTVWFVPSIKAGNDIANCLRKNGKKVIQLSRKTFDTEYQKTRLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGERINQILEENMDVEIWTKEGERKNLRPRWLDARTYSDPLALKEFKDFAAGRKSIALDLVTEIGRVPSHLAHRTRNALDNLVMLHTSEHGGRAYRHAVEELPETMETLLLLGLMILLTGGAMLFLISGKGIGKTSIGLICVIVSSGMLWMADVPLQWIASAIVLEFFMMVLLIPEPEKQRTPQDNQLAYVVIGILTLAAIVAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLVTHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGRRGTGSQGETLGEKWKKKLNQLSRKEFDLYKKSGITEVDRTEAKEGLKRGETTHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKYGGMLVRNPLSRNSTHEMYWISNGTGNIVSSVNMVSRLLLNRFTMTHRRPTIEKDVDLGAGTRHVNAEPETPNMDVIGERIKRIKEEHSSTWHYDDENPYKTWAYHGSYEVKATGSASSMINGVVKLLTKPWDVVPMVTQMAMTDTTPFGQQRVFKEKVDTRTPRPMPGTRKVMEITAEWLWRTLGRNKKPRLCTREEFTKKVRTNAAMGAVFTEENQWDSARAAVEDEEFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLASAIFKLTYQNKVVKVQRPTPKGTVMDIISRKDQRGSGQVGTYGLNTFTNMEAQLVRQMEGEGVLSKADLENPHLLEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLKETACLGKAYAQMWSLMYFHRRDLRLASNAICSAVPVHWVPTSRTTWSIHAHHQWMTTEDMLTVWNRVWIEDNPWMEDKTPVTTWEDVPYLGKREDQWCGSLIGLTSRATWAQNILTAIQQVRSLIGDEEFLDYMPSMKRFRKEEESEGAIW

SEQ ID NO: 5135 - protein, 3290 aa, Artificial Sequence
  derived and/or modified protein sequence (wt) from DENV-3__DQ675528__SS-prME
TSFCLMMMLPATLAFHLTSRDGEPRMIVGKNERGKSLLFKTASGINMCTLIAMDLGEMCDDTVTYKCPLIAEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAILPEEQDQNYVCKHTYVDRGWGNGCGLFGKGSLVTCAKFQCLEPIEGKVVQYENLKYTVIITVHTGDQHQVGNDTQGVTVEITPQASTVEAVLPEYGTLGLECSPRTGLDFNEMILLTMKNKAWMVHRQWFFDLPLPWTSGATTETPTWNRKELLVTFKNAHAKKQEVVVLGSQEGAMHTVLTGATEIQNSGGTSIFAGHLKCRLKMDKLELKGMSYAMCLNTFVLKKEVSETQHGTILIKVEYKGEDAPCKIPFSTEDGQGKAHNGRLITANPVVTKKEEPVNIEAEPPFGESNIVIGIGDKALKINWYKKGSSIGKMFEATARGARRMAILGDTAWDFGSVGGVLNSLGKMVHQIFGSAYTALFSGVSWIMKIGIGVLLTWIGLNSKNTSMSFSCIVIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAEIQNSSFIIDGPNTPECPSASRAWNVWEVEDYGFGVFTTNIWLKLREMYTQSCDHRLMSAAIKDERAVHADMGYWIESQKNGSWKLEKASFIEVKTCTWPKSHTLWSNGVLESDMIIPKSLAGPISQHNHRPGYHTQTAGPWHLGKLELDFNYCEGTTVVITENCGTRGPSLRTTTVSGKLIHEWCCRSCTLPPLRYMGEDGCWYGMEIRPINEKEENMVKSLVSAGSGKVDNFTMGVLCLAILFEEVMRGKFGKKHMIVGVLFTFVLLLSGQITWRDMAHTLIMIGSNASDRMGMGVTYLALIATFKIQPFLALGFFLRKLTSRENLLLGVGLAMATTLQLPEDIEQMANGIALGLMTLKLITQFETYQLWTALVSLTCSNTIFTLTVAWRTATLILAGVSLLPLCQSSSMRKTDWLPMTVAAMGVPPLPLFIFSLKDTPKRRSWPLNEGVMAVGLVSILASSLLRNDVPMAGPLVAGGLLIACYVITGTSADLTVEKAADVTWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTHNGKRLEPNWASVKKDLISYGGGWRLSAQWQKGEEVQVIAVEPGKNPKNFQTMPGIFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTAEAFPQSNAPIQDEERDIPERSWNSGNEWITDFVGKTVWFVPSIKAGNDIANCLRKNGKKVIQLSRKTFDTEYQKTRLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGERNNQILEENMDVEIWTKEGERKKLRPRWLDARTYSDPLALKEFKDFAAGRKSIALDLVTEIGRVPSHLAHRTRNALDNLVMLHTSEHGGRAYRHAVEELPETMETLLLLGLMILLTGGAMLFLISGKGIGKTSIGLICVIVSSGMLWMADVPLQWIASAIVLEFFMMVLLIPEPEKQRTPQDNQLAYVVIGILTLAAIVAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLVTHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGRRGTGSQGETLGEKWKKKLNQLSRKEFDLYKKSGITEVDRTEAKEGLKRGETTHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKYGGMLVRNPLSRNSTHEMYWISNGTGNIVSSVNMVSRLLLNRFTMTHRRPTIEKDVDLGAGTRHVNAEPETPNMDVIGERIKRIKEEHSSTWHYDDENPYKTWAYHGSYEVKATGSASSMINGVVKLLTKPWDVVPMVTQMAMTDTTPFGQQRVFKEKVDTRTPRPMPGTRKVMEITAEWLWRTLGRNKKPRLCTREEFTKKVRTNAAMGAVFTEENQWDSARAAVEDEEFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLASAIFKLTYQNKVVKVQRPTPKGTVMDIISRKDQRGSGQVGTYGLNTFTNMEAQLVRQMEGEGVLSKADLENPHLLEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLKETACLGKAYAQMWSLMYFHRRDLRLASNAICSAVPVHWVPTSRTTWSIHAHHQWMTTEDMLTVWNRVWIEDNPWMEDKTPVTTWEDVPYLGKREDQWCGSLIGLTSRATWAQNILTAIQQVRSLIGDEEFLDYMPSMKRFRKEEESEGAIW

SEQ ID NO: 5136 - protein, 3290 aa, Artificial Sequence
  derived and/or modified protein sequence (wt) from DENV-3__DQ675530__SS-prME
TSFCLMMMLPATLAFHLTSRDGEPRMIVGKNERGKSLLFKTASGINMCTLIAMDLGEMCDDTVTYKCPLIAEVEPEDIDCWCNLTSTWVTYGTCNQAGEHRRDKRSVALAPHVGMGLDTRTQTWMSAEGAWRQVEKVETWALRHPGFTILALFLAHYIGTSPTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAILPEEQDQNYVCKHTYVDRGWGNGCGLFGKGSLVTCAKFQCLEPIEGKVVQYENLKYTVIITVHTGDQHQVGNDTQGVTVEITPQASTVEAVLPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCLNTFVLKKEVSETQHGTILIKVEYKGEDAPCKIPFSTEDGQGKAHNGRLITANPVVTKKEEPVNIEAEPPFGESNIVIGIGDKALKINWYKKGSSIGKMFEATARGARRMAILGDTAWDFGSVGGVLNSLGKMVHQIFGSAYTALFSGVSWIMKIGIGVLLTWIGLNSKNTSMSFSCIVIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAEIQNSSFIIDGPNTPECPSASRAWNVWEVEDYGFGVFTTNIWLKLREMYTQSCDHRLMSAAIKDERAVHADMGYWIESQKNGSWKLEKASFIEVKTCTWPKSHTLWSNGVLESDMIIPKSLAGPISQHNHRPGYHTQTAGPWHLGKLELDFNYCEGTTVVITENCGTRGPSLRTTTVSGKLIHEWCCRSCTLPPLRYMGEDGCWYGMEIRPINEKEENMVKSLVSAGSGKVDNFTMGVLCLAILFEEVMRGKFGKKHMIVGVLFTFVLLLSGQITWRDMAHTLIMIGSNASDRMGMGVTYLALIATFKIQPFLALGFFLRKLTSRENLLLGVGLAMATTLQLPEDIEQMANGIALGLMTLKLITQFETYQLWTALVSLTCSNTIFTLTVAWRTATLILAGVSLLPLCQSSSMRKTDWLPMTVAAMGVPPLPLFIFSLKDTPKRRSWPLNEGVMAVGLVSILASSLLRNDVPMAGPLVAGGLLIACYVITGTSADLTVEKAADVTWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTHNGKRLEPNWASVKKDLISYGGGWRLSAQWQKGEEVQVIAVEPGKNPKNFQTMPGIFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTAEAFPQSNAPIQDEERDIPERSWNSGNEWITDFVGKTVWFVPSIKAGNDIANCLRKNGKKVIQLSRKTFDTEYQKTRLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGERNNQILEENMDVEIWTKEGERKKLRPRWLDARTYSDPLALKEFKDFAAGRKSIALDLVTEIGRVPSHLAHRTRNALDNLVMLHTSEHGGRAYRHAVEELPETMETLLLLGLMILLTGGAMLFLISGKGIGKTSIGLICVIVSSGMLWMADVPLQWIASAIVLEFFMMVLLIPEPEKQRTPQDNQLAYVVIGILTLAAIVAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLVTHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGRRGTGSQGETLGEKWKKKLNQLSRKEFDLYKKSGITEVDRTEAKEGLKRGETTHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKYGGMLVRNPLSRNSTHEMYWISNGTGNIVSSVNMVSRLLLNRFTMTHRRPTIEKDVDLGAGTRHVNAEPETPNMDVIGERIKRIKEEHSSTWHYDDENPYKTWAYHGSYEVKATGSASSMINGVVKLLTKPWDVVPMVTQMAMTDTTPFGQQRVFKEKVDTRTPRPMPGTRKVMEITAEWLWRTLGRNKKPRLCTREEFTKKVRTNAAMGAVFTEENQWDSARAAVEDEEFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLASAIFKLTYQNKVVKVQRPTPKGTVMDIISRKDQRGSGQVGTYGLNTFTNMEAQLVRQMEGEGVLSKADLENPHLLEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLKETACLGKAYAQMWSLMYFHRRDLRLASNAICSAVPVHWVPTSRTTWSIHAHHQWMTTEDMLTVWNRVWIEDNPWMEDKTPVTTWEDVPYLGKREDQWCGSLIGLTSRATWAQNILTAIQQVRSLIGDEEFLDYMPSMKRFRKEEESEGAIW

SEQ ID NO: 5137 - protein, 3290 aa, Artificial Sequence
  derived and/or modified protein sequence (wt) from DENV-3__DQ675533__SS-prME
TSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAVLPEEQDQNYVCKHTYVDRGWGNGCGLFGKGSLVTCAKFQCLEPIEGKVVQYENLKYTVIITVHTGDQHQVGNETQGVTAEITPQASTHEALLPEYGTLGLECSPRTGLDFNEMILLTMKNKAWMVHRQWFFDLPLPWASGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDAPCKIPFSTEDGQGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDTLGVLEQGKRTLTPQPMELKYSWKTWGKAKIVTAETQNSSFIIDGPNTPECPSASRAWNVWEVEDYGFGVFTTNIWLKLREVYTQLCDHRLMSAAVKDERAVHADMGYWIESQKNGSWKLEKASLIEVKTCTWPKSHTLWSNGVLESDMIIPKSLAGPISQHNYRPGYHTQTAGPWHLGKLELDFNYCEGTTVVITESCGTRGPSLRTTTVSGKLIHEWCCRSCTLPPLRYMGEDGCWYGMEIRPISEKEENMVKSLVSAGSGKVDNFTMGVLCLAILFEEVLRGKFGKKHMIAGVFFTFVLLLSGQITWRDMAHTLIMIGSNASDRMGMGVTYLALIATFKIQPFLALGFFLRKLTSRENLLLGVGLAMATTLQLPEDIEQMANGIALGLMALKLITQFETYQLWTALVSLTCSNTIFTLTVAWRTATLILAGVSLLPVCQSSSMRKTDWLPMTVAAMGVPPLPLLIFSLKDTLKRRSWPLNEGVMAVGLVSILASSLLRNDVPMAGPLVAGGLLIACYVITGTSADLTVEKAADVTWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTHNGKRLEPNWASVKKDLISYGGGWRLSAQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGERNNQILEENMDVEIWTKEGERKKLRPRWLDARTYSDPLALKEFKDFAAGRKSIALDLVTEIGRVPSHLAHRTRNALDNLVMLHTSEHGGRAYRHAVEELPETMETLLLLGLMILLTGGAMLFLISGKGIGKTSIGLICVIASSGMLWMAEVPLQWIASAIVLEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGETTHHAVSRGSAKLQWFVERNMVVPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVSSVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRPMPGTRKVMEITAEWLWRTLGRNKRPRLCTREEFTKKVRTNAAMGAVFTEENQWDSAKAAVEDEEFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKIIQQMDPEHRQLANAIFKLTYQNKVVKVQRPTPTGTVMDIISRKDQRGSGQVGTYGLNTFTNMEAQLVRQMEGEGVLTKADLENPHLLEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLRETACLGKAYAQMWSLMYFHRRDLRLASNAICSAVPVHWVPTSRTTWSIHAHHQWMTTEDMLTVWNRVWIEENPWMEDKTPVTTWENVPYLGKREDQWCGSLIGLTSRATWAQNIPTAIQQVRSLIGNEEFLDYMPSMKRFRKEEESEGAIW

SEQ ID NO: 5138 - protein, 3290 aa, Artificial Sequence
  derived and/or modified protein sequence (wt) from DENV-3__AY744677__SS-prME
TSLCLMMMLPATLAFHLTSRDGEPRMIVGKNERGKSLLFKTASGINMCTLIAMDLGEMCDDTVTYKCPLITEVEPEDIDCWCNLTSTWVTYGTCNQAGEHRRDKRSVALAPHVGMGLDTRTQTWMSAEGAWRQVEKVETWAFRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNVTTDSRCPTQGEAILPEEQDQNYVCKHTYVDRGWGNGCGLFGKGSLVTCAKFQCLESIEGKAVQHENLKYTVIITVHTGDQHQVGNETQGVTAEITPQASTVEAILPEYGTLGLECSPRTGLDFNEMILLTMKNKAWMVHRQWFFDLPLPWTSGATTETPTWNKKELLVTFKNAHAKKQEVVVLGSQEGAMHTALTGATEIQTSGGTSIFAGHLKCRLKMDKLELKGMSYAMCLNAFVLKKEVSETQHGTILIKVEYKGEDAPCKIPFSTEDGQGKAHNGRLITANPIVTKKEEPVNIEAEPPFGESNIVIGIGDKALKINWYKKGSSIGKMFEATARGARRMAILGDTAWDFGSVGGVLNSLGKMVHQIFGSAYTALFSGVSWIMKIGIGVLLTWIGLNSKNTSMSFSCIVIGIITLYLGAVVQADMGCVINWKGKELKCGSGIFVTNEVHTWTEQYKFQADSPKRLATAIAGAWENGVCGIRSTTRMENLLWKQIANELNYILWENNIKLTIVVGDVIGVLEQGKRTLTPQPMELKYSWKTWGKAKIVTAETQNSSFIIDGPNTPECPSASRAWNVWEVEDYGFGVFTTNIWLKLREMYTQLCDHRLMSAAVKDERAVHADMGYWIESQKNGSWKLEKASLIEVKTCTWPKSHTLWSNGVLESDMIIPKSLAGPISQHNYRPGYHTQTAGPWHLGKLELDFNYCEGTTVVITENCGTRGPSLRTTTVSGKLIHEWCCRSCTLPPLRYMGEDGCWYGMEIRPINEKEENMVKSLVSAGSGKADNFTMGVLCLAILFEEVMRGKFGKKHMIAGALFTFVLLLSGQITWRDMAHTLIMIGSNASDRMGMGVTYLALIATFKIQPFLALGFFLRKLTSRENLLLGVGLAMATTLQLPEDIEQMANGIALGLMALKLITQFETYQLWTALVSLMCSNTIFTLTVAWRTATLILAVISLLPVCQSSSMRKTDWLPMTVAAMGVPPLPLFIFSLKDTLKRRSWPLNEGVMAVGLVSILASSFLRNDVPMAGPLVAGGLLIACYVITGTSADLTVEKAADVTWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTHNGKRLEPNWANVKKDLISYGGGWKLSAQWQKGEEVQVIAVEPGKNPKNFQTMPGIFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIVMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTVASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGERNNQILEENMDVEIWTKEGEKKKLRPRWLDARTYSDPLALKEFKDFAAGRKSIALDLVTEIGRVPSHLAHRTRNALDNLVMLHTSEHGGRAYRHAVEELPETMETLLLLGLMILLTGGAMLFLISGKGIGKTSIGLICVVASSGMLWMADVPLQWIASAIVLEFFMMVLLIPEPEKQRTPQDNQLAYVVIGILTLAAIVAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLVTHYAIIGPGLQAKATREAQKRTAAGIMKNPTVDGIMTIDLDPVIYDSKFEKQLGQVMLLVLCAVQLLLMRTSWAFCEALTLATGPITTLWEGSPGKFWNTTIAVSMANIFRGSYLAGAGLAFSIMKSVGTGKRGTGSQGETLGEKWKKRLNQLSRKEFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVSSVNMVSRLLLNRFTMTHRRPTIEKDVDLGAGTRHVNAEPETPNMDVIGERIRRIKEEHSSTWHYDDENPYKTWAYHGSYEVKATGSASSMINGVVKLLTKPWDVVPMVTQMAMTDTTPFGQQRVFKEKVDTRTPRPMPGTRKVMEITAEWLWRTLGRNKRPRLCTREEFIKKVRTNAAMGAVFTEENQWDSARAAVEDEEFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPKGTVMDIISRKDQRGSGQVGTYGLNTFTNMEAQLIRQMEGEGVLSKADLENPHLLEKKVTQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLRETACLGKAYAQMWALMYFHRRDLRLASNAICSAVPVHWVPTSRTTWSIHAHHQWMTTEDMLTVWNRVWIEDNPWMEDKTPVTTWEDVPYLGKREDQWCGSLIGLTSRATWAQNILTAIQQVRSLIGNEEFLDYMPSMKRFRKEEESEGAIW

SEQ ID NO: 5139 - protein, 3290 aa, Artificial Sequence
  derived and/or modified protein sequence (wt) from DENV-3__AY744678__SS-prME
TSLCLMMMLPATLAFHLTSRDGEPRMIVGKNERGKSLLFKTASGINMCTLIAMDLGEMCDDTVTYKCPLITEVEPEDIDCWCNLTSTWVTYGTCNQAGEHRRDKRSVALAPHVGMGLDTRTQTWMSAEGAWRQVEKVETWAFRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNVTTDSRCPTQGEAILPEEQDQNYVCKHTYVDRGWGNGCGLFGKGSLVTCAKFQCLESIEGKAVQHENLKYTVIITVHTGDQHQVGNETQGVTAEITPQASTVEAILPEYGTLGLECSPRTGLDFNEMILLTMKNKAWMVHRQWFFDLPLPWTSGATTETPTWNKKELLVTFKNAHAKKQEVVVLGSQEGAMHTALTGATEIQTSGGTSIFAGHLKCRLKMDKLELKGMSYAMCLNAFVLKKEVSETQHGTILIKVEYKGEDAPCKIPFSTEDGQGKAHNGRLITANPIVTKKEEPVNIEAEPPFGESNIVIGIGDKALKINWYKKGSSIGKMFEATARGARRMAILGDTAWDFGSVGGVLNSLGKMVHQIFGSAYTALFSGVSWIMKIGIGVLLTWIGLNSKNTSMSFSCIVIGIITLYLGAVVQADMGCVINWKGKELKCGSGIFVTNEVHTWTEQYKFQADSPKRLATAIAGAWENGVCGIRSTTRMENLLWKQIANELNYILWENNIKLTIVVGDVIGVLEQGKRTLTPQPMELKYSWKTWGKAKIVTAETQNSSFIIDGPNTPECPSASRAWNVWEVEDYGFGVFTTNIWLKLREMYTQLCDHRLMSAAVKDERAVHADMGYWIESQKNGSWKLEKASLIEVKTCTWPKSHTLWSNGVLESDMIIPKSLAGPISQHNYRPGYHTQTAGPWHLGKLELDFNYCEGTTVVITENCGTRGPSLRTTTVSGKLIHEWCCRSCTLPPLRYMGEDGCWYGMEIRPINEKEENMVKSLVSAGSGKADNFTMGVLCLAILFEEVMRGKFGKKHMIAGALFTFVLLLSGQITWRDMAHTLIMIGSNASDRMGMGVTYLALIATFKIQPFLALGFFLRKLTSRENLLLGVGLAMATTLQLPEDIEQMANGIALGLMALKLITQFETYQLWTALVSLMCSNTIFTLTVAWRTATLILAVISLLPVCQSSSMRKTDWLPMTVAAMGVPPLPLFIFSLKDTLKRRSWPLNEGVMAVGLVSILASSFLRNDVPMAGPLVAGGLLIACYVITGTSADLTVEKAADVTWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTHNGKRLEPNWANVKKDLISYGGGWKLSAQWQKGEEVQVIAVEPGKNPKNFQTMPGIFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIVMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTVASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGERNNQILEENMDVEIWTKEGEKKKLRPRWLDARTYSDPLALKEFKDFAAGRKSIALDLVTEIGRVPSHLAHRTRNALDNLVMLHTSEHGGRAYRHAVEELPETMETLLLLGLMILLTGGAMLFLISGKGIGKTSIGLICVVASSGMLWMADVPLQWIASAIVLEFFMMVLLIPEPEKQRTPQDNQLAYVVIGILTLAAIVAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLVTHYAIIGPGLQAKATREAQKRTAAGIMKNPTVDGIMTIDLDPVIYDSKFEKQLGQVMLLVLCAVQLLLMRTSWAFCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVSSVNMVSRLLLNRFTMTHRRPTIEKDVDLGAGTRHVNAEPETPNMDVIGERIRRIKEEHSSTWHYDDENPYKTWAYHGSYEVKATGSASSMINGVVKLLTKPWDVVPMVTQMAMTDTTPFGQQRVFKEKVDTRTPRPMPGTRKVMEITAEWLWRTLGRNKRPRLCTREEFIKKVRTNAAMGAVFTEENQWDSARAAVEDEEFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPKGTVMDIISRKDQRGSGQVGTYGLNTFTNMEAQLIRQMEGEGVLSKADLENPHLLEKKVTQWLETKGVERLKRMAISGDDCVVKPIDDRFASALLALNDMGKVRKDIPQWQPSKGWHDWQQVPFCSHHFHELIMKDGRKLVVPCRPQDELIGRARISQGAGWSLRETACLGKAYAQMWALMYFHRRDLRLASNAICSAVPVHWVPTSRTTWSIHAHHQWMTTEDMLTVWNRVWIEDNPWMEDKTPVTTWEDVPYLGKREDQWCGSLIGLTSRATWAQNILTAIQQVRSLIGNEEFLDYMPSMKRFRKEEESEGAIW

SEQ ID NO: 5140 - protein, 3290 aa, Artificial Sequence
  derived and/or modified protein sequence (wt) from DENV-3__AY744679__SS-prME
TSLCLMMMLPATLAFHLTSRDGEPRMIVGKNERGKSLLFKTASGINMCTLIAMDLGEMCDDTVTYKCPLITEVEPEDIDCWCNLTSTWVTYGTCNQAGEHRRDKRSVALAPHVGMGLDTRTQTWMSAEGAWRQVEKVETWAFRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNVTTDSRCPTQGEAILPEEQDQNYVCKHTYVDRGWGNGCGLFGKGSLVTCAKFQCLESIEGKVVQHENLKYTVIITVHTGDQHQVGNETQGVTAEITPQASTVEAILPEYGTLGLECSPRTGLDFNEMILLTMKNKAWMVHRQWFFDLPLPWTSGATTETPTWNKKELLVTFKNAHAKKQEVVVLGSQEGAMHTALTGATEIQTSGGTSIFAGHLKCRLKMDKLELKGMSYAMCLNAFVLKKEVSETQHGTILIKVEYKGEDAPCKIPFSTEDGQGKAHNGRLITANPIVTKKEEPVNIEAEPPFGESNIVIGIGDKALKINWYKKGSSIGKMFEATARGARRMAILGDTAWDFGSVGGVLNSLGKMVHQIFGSAYTALFSGVSWIMKIGIGVLLTWIGLNSKNTSMSFSCIVIGIITLYLGAVVQADMGCVINWKGQELKCGSGIFVTNEVHTWTEQYKFQADSPKRLATAIAGAWENGVCGIRSTTRMENLLWKQIANELNYILWENNIKLTVVVGDVIGVLEQGKRTLTPQPMELKYSWKTWGKAKIVTAETQNSSFIIDGPNTPECPSASRAWNVWEVEDYGFGVFTTNIWLKLREMYTQLCDHRLMSAAVKDERAVHADMGYWIESQKNGSWKLEKASLIEVKTCTWPKSHTLWSNGVLESDMIIPKSLAGPISQHNYRPGYHTQTAGPWHLGKLELDFNYCEGTTVVITENCGTRGPSLRTTTVSGKLIHEWCCRSCTLPPLRYMGEDGCWYGMEIRPINEKEENMVKSLVSAGSGKADNFTMGVLCLAILFEEVMRGKFGKKHMIAGALFTFVLLLSGQITWRDMAHTLIMIGSNASDRMGMGVTYLALIATFKIQPFLALGFFLRKLTSRENLLLGVGLAMATTLQLPEDIEQMANGIALGLMALKLITQFETYQLWTALVSLMCSNTIFTLTVAWRTATLILAVISLLPVCQSSSMRKTDWLPMTVAAMGVPPLPLFIFSLKDTLKRRSWPLNEGVMAVGLVSILASSFLRNDVPMAGPLVAGGLLIACYVITGTSADLTVEKAADVTWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTHNGKRLEPNWANVKKDLISYGGGWKLSAQWQKGEEVQVIAVEPGKNPKNFQTMPGIFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIVMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTVASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGERNNQILEENMDVEIWTKEGEKKKLRPRWLDARTYSDPLALKEFKDFAAGRKSIALDLVTEIGRVPSHLAHRTRNALDNLVMLHTSEHGGRAYRHAVEELPETMETLLLLGLMILLTGGAMLFLISGKGIGKTSIGLICVVASSGMLWMADVPLQWIASAIVLEFFMMVLLIPEPEKQRTPQDNQLAYVVIGILTLAAIVAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLVTHYAIIGPGLQAKATREAQKRTAAGIMKNPTVDGIMTIDLDPVIYDSKFEKQLGQVMLLVLCAVQLLLMRTSWAFCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVSSVNMVSRLLLNRFTMTHRRPTIEKDVDLGAGTRHVNAEPETPNMDIIGERIRRIKEEHSSTWHYDDENPYKTWAYHGSYEVKATGSASSMINGVVKLLTKPWDVVPMVTQMAMTDTTPFGQQRVFKEKVDTRTPRPMPGTRKVMEITAEWLWRTLGRNKRPRLCTREEFMKKVRTNAAMGAVFTEENQWDSARAAVEDEEFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPKGTVMDIISRKDQRGSGQVGTYGLNTFTNMEAQLIRQMEGEGVLSKADLENPHLLEKKVTQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLRETACLGKAYAQMWALMYFHRRDLRLASNAICSAVPVHWVPTSRTTWSIHAHHQWMTTEDMLTVWNRVWIEDNPWMEDKTPVSTWEDVPYLGKREDQWCGSLIGLTSRATWAQNILTAIQQVRSLIGNEEFLDYMPSMKRFRKEEESEGAIW

SEQ ID NO: 5141 - protein, 3290 aa, Artificial Sequence
  derived and/or modified protein sequence (wt) from DENV-3__AY744680__SS-prME
TSLCLMMMLPATLAFHLTSRDGEPRMIVGKNERGKSLLFKTASGINMCTLIAMDLGEMCDDTVTYKCPLITEVEPEDIDCWCNLTSTWVTYGTCNQAGEHRRDKRSVALAPHVGMGLDTRTQTWMSAEGAWRQVEKVETWAFRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNVTTDSRCPTQGEAILPEEQDQNYVCKHTYVDRGWGNGCGLFGKGSLVTCAKFQCLESIEGKAVQHENLKYTVIITVHTGDQHQVGNETQGVTAEITPQASTVEAILPEYGTLGLECSPRTGLDFNEMILLTMKNKAWMVHRQWFFDLPLPWTSGATTETPTWNKKELLVTFKNAHAKKQEVVVLGSQEGAMHTALTGATEIQTSGGTSIFAGHLKCRLKMDKLELKGMSYAMCLNAFVLKKEVSETQHGTILIKVEYKGEDAPCKIPFSTEDGQGKAHNGRLITANPIVTKKEEPVNIEAEPPFGESNIVIGIGDKALKINWYKKGSSIGKMFEATARGARRMAILGDTAWDFGSVGGVLNSLGKMVHQIFGSAYTALFSGVSWIMKIGIGVLLTWIGLNSKNTSMSFSCIVIGIITLYLGAVVQADMGCVINWKGKELKCGSGIFVTNEVHTWTEQYKFQADSPKRLATAIAGAWENGVCGIRSTTRMENLLWKQIANELNYILWENNIKLTIVVGDVIGVLEQGKRTLTPQPMELKYSWKTWGKAKIVTAETQNSSFIIDGPNTPECPSASRAWNVWEVEDYGFGVFTTNIWLKLREMYTQLCDHRLMSAAVKDERAVHADMGYWIESQKNGSWKLEKASLIEVKTCTWPKSHTLWSNGVLESDMIIPKSLAGPISQHNYRPGYHTQTAGPWHLGKLELDFNYCEGTTVVITENCGTRGPSLRTTTVSGKLIHEWCCRSCTLPPLRYMGEDGCWYGMEIRPINEKEENMVKSLVSAGSGKADNFTMGVLCLAILFEEVMRGKFGKKHMIAGALFTFVLLLSGQITWRDMAHTLIMIGSNASDRMGMGVTYLALIATFKIQPFLALGFFLRKLTSRENLLLGVGLAMATTLQLPEDIEQMANGIALGLMALKLITQFETYQLWTALVSLMCSNTIFTLTVAWRTATLILAVISLLPVCQSSSMRKTDWLPMTVAAMGVPPLPLFIFSLKDTLKRRSWPLNEGVMAVGLVSILASSFLRNDVPMAGPLVAGGLLIACYVITGTSADLTVEKAADVTWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTHNGKRLEPNWANVKKDLISYGGGWKLSAQWQKGEEVQVIAVEPGKNPKNFQTMPGIFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIVMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTVASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGERNNQILEENMDVEIWTKEGEKKKLRPRWLDARTYSDPLALKEFKDFAAGRKSIALDLVTEIGRVPSHLAHRTRNALDNLVMLHTSEHGGRAYRHAVEELPETMETLLLLGLMILLTGGAMLFLISGKGIGKTSIGLICVVASSGMLWMADVPLQWIASAIVLEFFMMVLLIPEPEKQRTPQDNQLAYVVIGILTLAAIVAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLVTHYAIIGPGLQAKATREAQKRTAAGIMKNPTVDGIMTIDLDPVIYDSKFEKQLGQVMLLVLCAVQLLLMRTSWAFCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVSSVNMVSRLLLNRFTMTHRRPTIEKDVDLGAGTRHVNAEPETPNMDVIGERIRRIKEEHSSTWHYDDENPYKTWAYHGSYEVKATGSASSMINGVVKLLTKPWDVVPMVTQMAMTDTTPFGQQRVFKEKVDTRTPRPMPGTRKVMEITAEWLWRTLGRNKRPRLCTREEFIKKVRTNAAMGAVFTEENQWDSARAAVEDEEFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPKGTVMDIISRKDQRGSGQVGTYGLNTFTNMEAQLIRQMEGEGVLSKADLENPHLLEKKVTQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLRETACLGKAYAQMWALMYFHRRDLRLASNAICSAVPVHWVPTSRTTWSIHAHHQWMTTEDMLTVWNRVWIEDNPWMEDKTPVTTWEDVPYLGKREDQWCGSLIGLTSRATWAQNILTAIQQVRSLIGNEEFLDYMPSMKRFRKEEESEGAIW

SEQ ID NO: 5142 - protein, 3290 aa, Artificial Sequence
  derived and/or modified protein sequence (wt) from DENV-3__AY744681__SS-prME
TSLCLMMMLPATLAFHLTSRDGEPRMIVGKNERGKSLLFKTASGINMCTLIAMDLGEMCDDTVTYKCPLITEVEPEDIDCWCNLTSTWVTYGTCNQAGEHRRDKRSVALAPHVGMGLDTRTQTWMSAEGAWRQVEKVETWAFRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGRITNVTTDSRCPTQGEAILPEEQDQNYVCKHTYVDRGWGNGCGLFGKGSLVTCAKFQCLESIEGKAVQHENLKYTVIITVHTGDQHQVGSETQGVTAEITPQASTVEAILPEYGTLGLECSPRTGLDFNEMILLTMKNKAWMVHRQWFFDLPLPWTSGATTETPTWNKKELLVTFKNAHAKKQEVVVLGSQEGAMHTALTGATEIQTSGGTSIFAGHLKCRLKMDKLELKGMSYAMCLNAFVLKKEVSETQHGTILIKVEYKGEDAPCKIPFSTEDGQGKAHNGRLITANPIVTKKEEPVNIEAEPPFGESNIVIGIGDKALKINWYKKGSSIGKMFEATARGARRMAILGDTAWDFGSVGGVLNSLGKMVHQIFGSAYTALFSGVSWIMKIGIGVLLTWIGLNSKNTSMSFSCIVIGIITLYLGAVVQADMGCVINWKGKELKCGSGIFVTNEVHTWTEQYKFQADSPKRLATAIAGAWENGVCGIRSTTRMENLLWKQIANELNYILWENNIKLTIVVGDVIGVLEQGKRTLTPQPMELKYSWKTWGKAKIVTAETQNSSFIIDGPNTPECPSASRAWNVWEVEDYGFGVFTTNIWLKLREMYTQLCDHRLMSAAVKDERAVHADMGYWIESQKNGSWKLEKASLIEVKTCTWPKSHTLWSNGVLESDMIIPKSLAGPISQHNYRPGYHTQTAGPWHLGKLELDFNYCEGTTVVITENCGTRGPSLRTTTVSGKLIHEWCCRSCTLPPLRYMGEDGCWYGMEIRPINEKEENMVKSLVSAGSGKADNFTMGVLCLAILFEEVMRGKFGKKHMIAGALFTFVLLLSGQITWRDMAHTLIMIGSNASDRMGMGVTYLALIATFKIQPFLALGFFLRKLTSRENLLLGVGLAMATTLQLPEDIEQMANGIALGLMALKLITQFETYQLWTALVSLMCSNTIFTLTVAWRTATLILAVISLLPVCQSSSMRKTDWLPMTVAAMGVPPLPLFIFSLKDTLKRRSWPLNEGVMAVGLVSILASSFLRNDVPMAGPLVAGGLLIACYVITGTSADLTVEKAADVTWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTHNGKRLEPNWANVKKDLISYGGGWKLSAQWQKGEEVQVIAVEPGKNPKNFQTMPGIFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIVMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTVASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGERNNQILEENMDVEIWTKEGEKKKLRPRWLDARTYSDPLALKEFKDFAAGRKSIALDLVTEIGRVPSHLAHRTRNALDNLVMLHTSEHGGRAYRHAVEELPETMETLLLLGLMILLTGGAMLFLISGKGIGKTSIGLICVVASSGMLWMADVPLQWIASAIVLEFFMMVLLIPEPEKQRTPQDNQLAYVVIGILTLAAIVAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLVTHYAIIGPGLQAKATREAQKRTAAGIMKNPTVDGIMTIDLDPVIYDSKFEKQLGQVMLLVLCAVQLLLMRTSWAFCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVSSVNMVSRLLLNRFTMTHRRPTIEKDVDLGAGTRHVNAEPETPNMDVIGERIRRIKEEHSSTWHYDDENPYKTWAYHGSYEVKATGSASSMINGVVKLLTKPWDVVPMVTQMAMTDTTPFGQQRVFKEKVDTRTPRPMPGTRKVMEITAEWLWRTLGRNKRPRLCTREEFIKKVRTNAAMGAVFTEENQWDSARAAVEDEEFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRRLANAIFKLTYQNKVVKVQRPTPKGTVMDIISRKDQRGSGQVGTYGLNTFTNMEAQLIRQMEGEGVLSKADLENPHLLEKKVTQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLRETACLGKAYAQMWALMYFHRRDLRLASNAICSAVPVHWVPTSRTTWSIHAHHQWMTTEDMLTVWNRVWIEDNPWMEDKTPVTTWEDVPYLGKREDQWCGSLIGLTSRATWAQNILTAIQQVRSLIGNEEFLDYMPSMKRFRKEEESEGAIW

SEQ ID NO: 5143 - protein, 3290 aa, Artificial Sequence
  derived and/or modified protein sequence (wt) from DENV-3__AY744682__SS-prME
TSLCLMMMLPATLAFHLTSRDGEPRMIVGKNERGKSLLFKTASGINMCTLIAMDLGEMCDDTVTYKCPLITEVEPEDIDCWCNLTSTWVTYGTCNQAGEHRRDKRSVALAPHVGMGLDTRTQTWMSAEGAWRQVEKVETWAFRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNVTTDSRCPTQGEAILPEEQDQNYVCKHTYVDRGWGNGCGLFGKGSLVTCAKFQCLESIEGKAVQHENLKYTVTITVHTGDQHQVGNETQGVTAEITPQASTVEAILPEYGTLGLECSPRTGLDFNEMILLTMKNKAWMVHRQWFFDLPLPWTSGATTETPTWNKKELLVTFKNAHAKKQEVVVLGSQEGAMHTALTGATEIQTSGGTSIFAGHLKCRLKMDKLELKGMSYAMCLNAFVLKKEVSETQHGTILIKVEYKGEDAPCKIPFSTEDGQGKAHNGRLITANPIVTKKEEPVNIEAEPPFGESNIVIGIGDKALKINWYKKGSSIGKMFEATARGARRMAILGDTAWDFGSVGGVLNSLGKMVHQIFGSAYTALFSGVSWIMKIGIGVLLTWIGLNSKNTSMSFSCIVIGIITLYLGAVVQADMGCVINWKGKELKCGSGIFVTNEVHTWTEQYKFQADSPKRLATAIAGAWENGVCGIRSTTRMENLLWKQIANELNYILWENNIKLTIVVGDVIGVLEQGKRTLTPQPMELKYSWKTWGKAKIVTAETQNSSFIIDGPNTPECPSASRAWNVWEVEDYGFGVFTTNIWLKLREVYTQLCDHRLMSAAVKDERAVHADMGYWIESQKNGSWKLEKASLIEVKTCTWPKSHTLWSNGVLESDMIIPKSLAGPISQHNYRPGYHTQTAGPWHLGKLELDFNYCEGTTVVITENCGTRGPSLRTTTVSGKLIHEWCCRSCTLPPLRYMGEDGCWYGMEIRPINEKEENMVKSLVSAGSGKADNFTMGVLCLAILFEEVMRGKFGKKHMISGALFTFVLLLSGQITWRDMAHTLIMIGSNASDRMGMGVTYLALIATFKIQPFLALGFFLRKLTSRENLLLGVGLAMATTLQLPEDIEQMANGIALGLMALKLITQFETYQLWTALVSLMCSNTIFTLTVAWRTATLILAVISLLPVCQSSSMRKTDWLPMTVAAMGVPPLPLFIFSLKDTLKRRSWPLNEGVMAVGLVSILASSFLRNDVPMAGPLVAGGLLIACYVITGTSADLTVEKAADVTWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTHNGKRLEPNWANVKKDLISYGGGWKLSAQWQKGEEVQVIAVEPGKNPKNFQTMPGIFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIVMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTVASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGERNNQILEENMDVEIWTKEGEKKKLRPRWLDARTYSDPLALKEFKDFAAGRKSIALDLVTEIGRVPSHLAHRTRNALDNLVMLHTSEHGGRAYRHAVEELPETMETLLLLGLMILLTGGAMLFLISGKGIGKTSIGLICVVASSGMLWMADVPLQWIASAIVLEFFMMVLLIPEPEKQRTPQDNQLAYVVIGILTLAAIVAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLVTHYAIIGPGLQAKATREAQKRTAAGIMKNPTVDGIMTIDLDPVIYDSKFEKQLGQVMLLVLCAVQLLLMRTSWAFCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVSSVNMVSRLLLNRFTMTHRRPTIEKDVDLGAGTRHVNAEPETPNMDVIGERIRRIKEEHSSTWHYDDENPYKTWAYHGSYEVKATGSASSMINGVVKLLTKPWDVVPMVTQMAMTDTTPFGQQRVFKEKVDTRTPRPMPGTRKVMEITAEWLWRTLGRNKRPRLCTREEFIKKVRTNAAMGAVFTEENQWDSARAAVEDEEFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPKGTVMDIISRKDQRGSGQVGTYGLNTFTNMEAQLIRQMEGEGVLSKADLENPYLLEKKVTQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLRETACLGKAYAQMWALMYFHRRDLRLASNAICSAVPVHWVPTSRTTWSIHAHHQWMTTEDMLTVWNRVWIEDNPWMEDKTPVTTWEDVPYLGKREDQWCGSLIGLTSRATWAQNILTAIQQVRSLIGNEEFLDYMPSMKRFRKEEESEGAIW

SEQ ID NO: 5144 - protein, 3290 aa, Artificial Sequence
  derived and/or modified protein sequence (wt) from DENV-3__AY744683__SS-prME
TSLCLMMMLPATLAFHLTSRDGEPRMIVGKNERGKSLLFKTASGINMCTLIAMDLGEMCDDTVTYKCPLITEVEPEDIDCWCNLTSTWVTYGTCNQAGEHRRDKRSVALAPHVGMGLDTRTQTWMSAEGAWRQVEKVETWAFRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNVTTDSRCPTQGEAILPEEQDQNYVCKHTYVDRGWGNGCGLFGKGSLVTCAKFQCLESIEGKAVQHENLKYTVIITVHTGDQHQVGNETQGVTAEITPQASTVEAILPEYGTLGLECSPRTGLDFNEMILLTMKNKAWMVHRQWFFDLPLPWTSGATTETPTWNKKELLVTFKNAHAKKQEVVVLGSQEGAMHTALTGATEIQTSGGTSIFAGHLKCRLKMDKLELKGMSYAMCLNAFVLKKEVSETQHGTILIKVEYKGEDAPCKIPFSTEDGQGKAHNGRLITANPIVTKKEEPVNIEAEPPFGESNIVIGIGDKALKINWYKKGSSIGKMFEATARGARRMAILGDTAWDFGSVGGVLNSLGKMVHQIFGSAYTALFSGVSWIMKIGIGVLLTWIGLNSKNTSMSFSCIVIGIITLYLGAVVQADMGCVINWKGKELKCGSGIFVTNEVHTWTEQYKFQADSPKRLATAIAGAWENGVCGIRSTTRMENLLWKQIANELNYILWENNIKLTIVVGDVIGVLEQGKRTLTPQPMELKYSWKTWGKAKIVTAETQNSSFIIDGPNTPECPSASRAWNVWEVEDYGFGVFTTNIWLKLREMYTQLCDHRLMSAAVKDERAVHADMGYWIESQKNGSWKLEKASLIEVKTCTWPKSHTLWSNGVLESDMIIPKSLAGPISQHNYRPGYHTQTAGPWHLGKLELDFNYCEGTTVVITENCGTRGPSLRTTTVSGKLIHEWCCRSCTLPPLRYMGEDGCWYGMEIRPINEKEENMVKSLVSAGSGKADNFTMGVLCLAILFEEVMRGKFGKKHMIAGALFTFVLLLSGQITWRDMAHTLIMIGSNASDRMGMGVTYLALIATFKIQPFLALGFFLRKLTSRENLLLGVGLAMATTLQLPEDIEQMANGIALGLMALKLITQFETYQLWTALVSLMCSNTIFTLTVAWRTATLILAVISLLPVCQSSSMRKTDWLPMTVAAMGVPPLPLFIFSLKDTLKRRSWPLNEGVMAVGLVSILASSFLRNDVPMAGPLVAGGLLIACYVITGTSADLTVEKAADVTWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTHNGKRLEPNWANVKKDLISYGGGWKLSAQWQKGEEVQVIAVEPGKNPKNFQTMPGIFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIVMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTVASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGERNNQILEENMDVEIWTKEGEKKKLRPRWLDARTYSDPLALKEFKDFAAGRKSIALDLVTEIGRVPSHLAHRTRNALDNLVMLHTSEHGGRAYRHAVEELPETMETLLLLGLMILLTGGAMLFLISGKGIGKTSIGLICVVASSGMLWMADVPLQWIASAIVLEFFMMVLLIPEPEKQRTPQDNQLAYVVIGILTLAAIVAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLVTHYAIIGPGLQAKATREAQKRTAAGIMKNPTVDGIMTIDLDPVIYDSKFEKQLGQVMLLVLCAVQLLLMRTSWAFCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVSSVNMVSRLLLNRFTMTHRRPTIEKDVDLGAGTRHVNAEPETPNMDVIGERIRRIKEEHSSTWHYDDENPYKTWAYHGSYEVKATGSASSMINGVVKLLTKPWDVVPMVTQMAMTDTTPFGQQRVFKEKVDTRTPRPMPGTRKVMEITAEWLWRTLGRNKRPRLCTREEFIKKVRTNAAMGAVFTEENQWDSARAAVEDEEFWKLVDRERELHKLGKCGSCVYNMMGKREKKLGEFGKAKGSRAIWYMWLGARFLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPKGTVMDIISRKDQRGSGQVGTYGLNTFTNMEAQLIRQMEGEGVLSKADLENPHLLEKKVTQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLRETACLGKAYAQMWALMYFHRRDLRLASNAICSAVPVHWVPTSRTTWSIHAHHQWMTTEDMLTVWNRVWIEDNPWMEDKTPVTTWEDVPYLGKREDQWCGSLIGLTSRATWAQNILTAIQQVRSLIGNEEFLDYMPSMKRFRKEEESEGAIW

SEQ ID NO: 5145 - protein, 3290 aa, Artificial Sequence
  derived and/or modified protein sequence (wt) from DENV-3__AY744684__SS-prME
TSLCLMMMLPATLAFHLTSRDGEPRMIVGKNERGKSLLFKTASGINMCTLIAMDLGEMCDDTVTYKCPLITEVEPEDIDCWCNLTSTWVTYGTCNQAGEHRRDKRSVALAPHVGMGLDTRTQTWMSAEGAWRQVEKVETWAFRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNVTTDSRCPTQGEAILPEEQDQNYVCKHTYVDRGWGNGCGLFGKGSLVTCAKFQCLESIEGKAVQHENLKYTVIITVHTGDQHQVGNETQGVTAEITPQASTVEAILPEYGTLGLECSPRTGLDFNEMILLTMKNKAWMVHRQWFFDLPLPWTSGATTETPTWNKKELLVTFKNAHAKKQEVVVLGSQEGAMHTALTGATEIQTSGGTSIFAGHLKCRLKMDKLELKGMSYAMCLNAFVLKKEVSETQHGTILIKVEYKGEDAPCKIPFSTEDGQGKAHNGRLITANPIVTKKEEPVNIEAEPPFGESNIVIGIGDKALKINWYKKGSSIGKMFEATARGARRMAILGDTAWDFGSVGGVLNSLGKMVHQIFGSAYTALFSGVSWIMKIGIGVLLTWIGLNSKNTSMSFSCIVIGIITLYLGAVVQADMGCVINWKGKELKCGSGIFVTNEVHTWTEQYKFQADSPKRLATAIAGAWENGVCGIRSTTRMENLLWKQIANELNYILWENNIKLTIVVGDVIGVLEQGKRTLTPQPMELKYSWKTWGKAKIVTAETQNSSFIIDGPNTPECPSASRAWNVWEVEDYGFGVFTTNIWLKLREMYTQLCDHRLMSAAVKDERAVHADMGYWIESQKNGSWKLEKASLIEVKTCTWPKSHTLWSNGVLESDMIIPKSLAGPISQHNYRPGYHTQTAGPWHLGKLELDFNYCEGTTVVITENCGTRGPSLRTTTVSGKLIHEWCCRSCTLPPLRYMGEDGCWYGMEIRPINEKEENMVKSLVSAGSGKADNFTMGVLCLAILFEEVMRGKFGKKHMIAGALFTFVLLLSGQITWRDMAHTLIMIGSNASDRMGMGVTYLALIATFKIQPFLALGFFLRKLTSRENLLLGVGLAMATTLQLPEDIEQMANGIALGLMALKLITQFETYQLWTALVSLMCSNTISTLTVAWRTATLILAVISLLPVCQSSSMRKTDWLPMTVAAMGVPPLPLFIFSLKDTLKRRSWPLNEGVMAVGLVSILASSFLRNDVPMAGPLVAGGLLIACYVITGTSADLTVEKAADVTWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTHNGKRLEPNWANVKKDLISYGGGWKLSAQWQKGEEVQVIAVEPGKNPKNFQTMPGIFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIVMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTVASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGERNNQILEENMDVEIWTKEGEKKKLRPRWLDARTYSDPLALKEFKDFAAGRKSIALDLVTEIGRVPSHLAHRTRNALDNLVMLHTSEHGGRAYRHAVEELPETMETLLLLGLMILLTGGAMLFLISGKGIGKTSIGLICVVASSGMLWMADVPLQWIASAIVLEFFMMVLLIPEPEKQRTPQDNQLAYVVIGILTLAAIVAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLVTHYAIIGPGLQAKATREAQKRTAAGIMKNPTVDGIMTIDLDPVIYDSKFEKQLGQVMLLVLCAVQLLLMRTSWAFCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVSSVNMVSRLLLNRFTMTHRRPTIEKDVDLGAGTRHVNAEPETPNMDVIGERIRRIKEEHSSTWHYDDENPYKTWAYHGSYEVKATGSASSMINGVVKLLTKPWDVVPMVTQMAMTDTTPFGQQRVFKEKVDTRTPRPMPGTRKVMEITAEWLWRTLGRNKRPRLCTREEFIKKVRTNAAMGAVFTEENQWDSARAAVEDEEFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPKGTVMDIISRKDQRGSGQVGTYGLNTFTNMEAQLIRQMEGEGVLSKADLENPHLLEKKVTQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLRETACLGKAYAQMWALMYFHRRDLRLASNAICSAVPVHWVPTSRTTWSIHAHHQWMTTEDMLTVWNRVWIEDNPWMEDKTPVTTWEDVPYLGKREDQWCGSLIGLTSRATWAQNILTAIQQVRSLIGNEEFLDYMPSMKRFRKEEESEGAIW

SEQ ID NO: 5146 - protein, 3290 aa, Artificial Sequence
  derived and/or modified protein sequence (wt) from DENV-3__AY744685__SS-prME
TSLCLMMMLPATLAFHLTSRDGEPRMIVGKNERGKSLLFKTASGINMCTLIAMDLGEMCDDTVTYKCPLITEVEPEDIDCWCNLTSTWVTYGTCNQAGEHRRDKRSVALAPHVGMGLDTRTQTWMSAEGAWRQVEKVETWAFRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNVTTDSRCPTQGEAILPEEQDQNYVCKHTYVDRGWGNGCGLFGKGSLVTCAKFQCLESIEGKAVQHENLKYTVIITVHTGDQHQVGNEMQGVTAEITPQASTVEAILPEYGTLGLECSPRTGLDFNEMILLTMKNKAWMVHRQWFFDLPLPWTSGATTETPTWNKKELLVTFKNAHAKKQEVVVLGSQEGAMHTALTGATEIQTSGGTSIFAGHLKCRLKMDKLELKGMSYAMCLNAFVLKKEVSETQHGTILIKVEYKGEDAPCKIPFSTEDGQGKAHNGRLITANPIVTKKEEPVNIEAEPPFGESNIVIGIGDKALKINWYKKGSSIGKMFEATARGARRMAILGDTAWDFGSVGGVLNSLGKMVHQIFGSAYTALFSGVSWIMKIGIGVLLTWIGLNSKNASMSFSCIVIGIITLYLGAVVQADMGCVINWKGKELKCGSGIFVTNEVHTWTEQYKFQADSPKRLATAIAGAWENGVCGIRSTTRMENLLWKQIANELNYILWENNIKLTIVVGDVIGVLEQGKRTLTPQPMELKYSWKTWGKAKIVTAETQNSSFIIDGPNTPECPSALRAWNVWEVEDYGFGVFTTNIWLKLREKYTQLCDHRLMSAAVKDERAVHADMGYWIESQKNGSWKLEKASLIEVKTCTWPKSHTLWSNGVLESDMIIPKSLAGPISQHNYRPGYHTQTAGPWHLGKLELDFNYCEGTTVVITENCGIRGPSLRTTTVSGKLIHEWCCRSCTLPPLRYMGEDGCWYGMEIRPINEKEENMVKSLVSAGSGKTDNFTMGVLCLAILFEEVMRGKFGKKHMIAGALFTFVLLLSGQITWRDMAHTLIMIGSNASDRMGMGVTYLALIATFKIQPFLALGFFLRKLTSRENLLLGVGLAMATTLQLPEDIEQMANGIALGLMALKLITQFETYQLWTALISLMCSNTIFTLTVAWRTATLILAVISLLPVCQSSSMRKTDWLPMTVAAMGVPPLPLFIFSLKDTLKRRSWPLNEGVMAVGLVSILASSFLRNDVPMAGPLVAGGLLIACYVITGTSADLTVEKAADVTWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTHNGKRLEPNWANVKKDLISYGGGWKLSAQWQKGEEVQVIAVEPGKNPKNFQTMPGIFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIVMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTVASAAQRRGRVGRNSQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGERNNQILEENMDVEIWTKEGEKKKLRPRWLDARTYSDPLALKEFKDFAAGRKSIALDLVTEIGRVPSHLAHRTRNALDNLVMLHTSEHGGRAYRHAVEELPETMETLLLLGLMILLTGGAMLFLISGKGIGKTSIGLICVVASSGMLWMADVPLQWIASAIVLEFFMMVLLIPEPEKQRTPQDNQLAYVVIGILTLAAIVAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLVTHYAIIGPGLQAKATREAQKRTAAGIMKNPTVDGIMTIDLDPVIYDSKFEKQLGQVMLLVLCAVQLLLMRTSWAFCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVSSVNMVSRLLLNRFTMTHRRPTIEKDVDLGAGTRHVNAEPETPNMDVIGERIRRIKEEHSSTWHYDDENPYKTWAYHGSYEVKATGSASSMINGVVKLLTKPWDVVPMVTQMAMTDTTPFGQQRVFKEKVDTRTPRPMPGTRKVMEITAEWLWRTLGRNKRPRLCTREEFIKKVRTNAAMGAVFTEENQWDSARAAVEDEEFWKLVDRERELHKLGKCGSCVYNMMGKREKKLGEFGKAKGSRAIWYMWLGARYLEFEALGFLNEDHWFSRENSHSGVEGEGLHKLGYILRDISKIPGGAMYADDTAGWDTRITEDDLHNEEKITQQMDPEHRQLANAIFKLTYQNKVVKVQRPTPKGTVMDIISRKDQRGSGQVGTYGLNTFTNMEAQLIRQMEGEGVLSKADLENPHLLEKKVTQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLRETACLGKAYAQMWALMYFHRRDLRLASNAICSAVPVHWVPTSRTTWSIHAHHQWMTTEDMLTVWNRVWIEDNPWMEDKTPVTTWEDVPYLGKREDQWCGSLIGLTSRATWAQNILTAIQQVRSLIGNEEFLDYMPSMKRFRKEEESEGAIW

SEQ ID NO: 5147 - protein, 3290 aa, Artificial Sequence
  derived and/or modified protein sequence (wt) from DENV-3__AY876494__SS-prME
TSLCLMMMLPATLAFHLTSRDGEPRMIVAKNERGKSLLFKTASGINMCTLIAMDLGEMCDDTVTYKCPLIAEVEPEDIDCWCNLTSTWVTYGTCNQAGEHRRDKRSVALAPHVGMGLDTRTQTWMSAEGAWRPVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNVTTDSRCPTQGEAILPEEQDQNYVCKHTYVDRGWGNGCGLFGKGSLVTCAKFQCLEPIEGKVVQHENLKYTVIITVHTGDQHQVGNDTQGVTVEITPQASTAEAILPEYGTLVLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCLNTFVLKKEVSETQHGTILIKVEYKGEDAPCKIPFSTEDGQGKAHNGRLITANPVVTKKEEPVNIEAEPPFGESNIVIGIGDKALKINWYKKGSSIGKMFEATARGARRMAILGDTAWDFGSVGGVLNSLGKMVHQIFGSAYTALFSGVSWIMKIGIGVLLTWIGLNSKNTSMSFSCIVIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSASRAWNVWEVEDYGFGVFTTNIWLKLREVYTQSCDHRLMSAAIKDERAVHADMGYWIESQKNGSWKLEKASFIEVKTCTWPKSHTLWSNGVLESDMIIPKSLAGPISQHNHRPGYYTQTAGPWHLGKLELDFNYCEGTTVVITENCGTRGPSLRTTTVSGKLIHEWCCRSCTLPPLRYMGEDGCWYGMEIRPINEKEENMVKSLVSAGSGKVDNFTMGVLCLAILFEEVMRGKFGKKHMIAGVLFTFVLLLSGQITWRDMAHTLIMIGSNASDRTGMGVTYLALIATFKIQPFLALGFFLRKLTSRENLLLGVGLAMATTLQLPEDIEQMANGIALGLMTLKLITQFETYQLWTALVSLTCSNTIFTLTVAWRTATLILAGVSLLPLCQSSSMRKTDWLPMTVAAMGVPPLPLFIFSLKDTPKRRSWPLNEGVMAVGLVSILASSLLRNDVPMAGPLVAGGLLIACYVITGTSADLTVEKAADVTWEEEAEQTGVSHNLMITVDDDGTMRIKDDETENIPTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTHNGKRLEPNWASVKKDLISYGGGWRLSAQWQKGEEVQVIAVEPGKNPKNFQTMPGIFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTAEAFPQSNAPIQDEERDIPERSWNSGNEWITDFVGKTVWFVPSIKAGNDIANCLRKNGKKVIQLSRKTFDTEYQKTRLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGERNNQILEENMDVEIWTKEGERKKLRPRWLDARTYSDPLALKEFKDFAAGRKSIALDLVTEIGRVPSHLAHRTRNALDNLVMLHTSEHGGRAYRHAVEELPETMETLLLLGLMILLTGGAMLFLISGKGIGKTSIGLICVIVSSGMLWMADVPLQWIASAIVLEFFMMVLLIPEPEKQRTPQDNQLAYVVIGILTLAAIVAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLVTHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGETTHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKYGGMLVRNPLSRNSTHEMYWISNGTGNIVSSVNMVSRLLLNRFTMTHRRPTIEKDVDLGAGTRHVNAEPETPNMDVIGERIKRIKEEHSSTWHYDDENPYKTWAYHGSYEVKATGSASSMINGVVKLLTKPWDVVPMVTQMAMTDTTPFGQQRVFKEKVDTRTPRPMPGTRKVMEITAEWLWRTLGRNKRPRLCTREEFTKKVRTNAAMGAVFTEENQWDSARAAVEDEEFWNLWDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPKGTVMDIISRKDQRGSGQVGTYGLNTFTNMEAQLVRQMEGEGVLSKADLENPHLLEKKITPWLEPKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLKETACLGKAYAQMWSLMYFHRRDLRLASNAICSAVPVHWVPTSRTTWSIHAHHQWMTTEDMLTVWNRVWIEDNPWMEDKTPVTTWEDVPYLGKREDQWCGSLIGLTSRSTWAQNILTAIQQVRSLIGDEEFLDYMPSMKRFRKEEESEGAIW

SEQ ID NO: 5148 - protein, 3290 aa, Artificial Sequence
  derived and/or modified protein sequence (wt) from DENV-3__AY923865__SS-prME
TSLCLMMMLPATLAFHLTSRDGEPRMIVGKNERGKSLLFKTASGINMCTLIAMDLGEMCDDTVTYKCPLIAEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTGSRCPTQGEAILPEEQDQNYVCKHTYVDRGWGNGCGLFGKGSLVTCAKFQCLEPIEGKVVQYENLKYTVIITVHTGDQPQVGNDTQGVTVEITPQASTVEAVLLEYGTLGLKCSPRTGLDFNEMILLTMKTKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCLNTFVLKKEVSETQHGTILIKVEYKGEDAPCKIPFSTEDGQGKAHNGRLITANPVVTKKEEPVNIEAEPPFGESNIVIGIGDKALKINWYKKGSSIGKMFEATARGARRMAILGDTAWDFGSVGGVLNSLGKMVHQIFGSAYTALFSGVSWIMKIGIGVLLTWIGLNSKNTSMSFSCIVIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSASRAWNVWEVEDYGFGVFTTNIWLKLREVYTQSCDHRLMSAAIKDERAVHADMGYWIESQKNGSWKLEKASFIEVKTCTWPKSHTLWSNGVLESDMIIPKSLAGPISQHNHRPGYHTQTAGPWHLGKLELDFNYCEGTTVVITENCGTRGPSLRTTTVSGKLIHEWCCRSCTLPPLRYMGEDGCWYGMEIRPINEKEENMVKSLVSAGSGKVDNFTMGVLCLAILFEEVMRGKFGKKHMIAGVLFTFVLLLSGQITWRDMAHTLIMIGSNASDRMGMGVTYLALIATFKIQPFLALGFFLRKLTSRENLLLGVGLAMATTLQLPEDIEQMANGIALGLMTLKLITQFETYQLWTALVSLTCSNTIFTLTVAWRTATLILAGVSLLPLCQSSSMRKTDWLPMTVAAMGVPPLPLFIFSLKDTPKRRSWPLNEGVMAVGLVSILASSLLRNDVPMAGPLVAGGLLIACYVITGTSADLTVEKAADVTWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTHNGKRLEPNWASVKKDLISYGGGWRLSAQWQKGEEVQVIAVEPGKNPKNFQTMPGIFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTAEAFPQSNAPIQDEERDIPERSWNSGNEWITDFVGKTVWFVPSIKAGNDIANCLRKNGKKVIQLSRKTFDTEYQKTRLNDWDFLVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGERNNQILEENMDVEIWTKEGERKKLRPRWLDARTYSDPLALKEFKDFAAGRKSIALDLVTEIGRVPSHLAHRTRNALDNLVMLHTSEHGGRAYRHAVEELPETMETLLLLGLMILLTGGAMLFLISGKGIGKTSIGLICVIVSSGMLWMADVPLQWIASAIVLEFFMMVLLIPEPEKQRTPQDNQLAYVVIGILTLAAIVAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLVTHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGTGLAFSIMKSVGTGRRGTGSQGETLGEKWKKKLNQLSRKEFDLYKKSGITEVDRTEAKEGLKRGETTHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKYGGMLVRNPLSRNSTHEMYWISNGTGNIVSSVNMVSRLLLNRFTMTHRRPTIEKDVDLGAGTRHVNAEPETPNMDVIGERIKRIKEEHSSTWHYDDENPYKTWAYHGSYEVKATGSASSMINGVVKLLTKPWDVVPMVTQMAMTDTTPFGQQRVFKEKVDTRTPRPMPGTRKVMEITAEWLWRTLGRNKKPRLCTREEFTKKVRTNAAMGAVFTEENQWDSARAAVEDEEFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPKGTVMDIISRKDQRGSGQVGTYGLNTFTNMEAQLVRQMEGEGVLSKADLENPHLLEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLKETACLGKAYAQMWSLMYFHRRDLRLASNAICSAVPVHWVPTSRTTWSIHAHHQWMTTEDMLTVWNRVWIEDNPWMEDKTPVTTWEDVPYLGKREDQWCGSLIGLTSRATWAQNILTAIQQVRSLIGDEEFLDYMPSMKRFRKEEESEGAIW

SEQ ID NO: 5149 - protein, 3288 aa, Artificial Sequence
  derived and/or modified protein sequence (wt) from DENV-4__KR922405__SS-prME
STITLLCLIPTVMAFHLSTRDGEPLMIVAKHERGRPLLFKTTEGINKCTLIAMDLGEMCEDTVTYKCPLLVNTEPEDIDCWCNLTSAWVMYGTCTQSGERRREKRSVALTPHSGMGLETRAETWMSSEGAWKHAQRVESWILRNPGFALLAGFMAYMIGQTGIQRTVFFILMMLVAPSYGMRCVGVGNRDFVEGVSGGAWVDLVLEHGGCVTTMAQGKPTLDFELIKTTAKEVALLRTYCIEASISNITTATRCPTQGEPYLKEEQDQQYICRRDMVDRGWGNGCGLFGKGGVVTCAKFSCLGKITGNLVQIENLEYTVVVTVHNGDTHAVGNDTSNHGVTATITPRSPSVEVKLPDYGELTLDCEPRSGIDFNEMILMKMKTKTWLVHKQWFLDLPLPWTTGADTLEVHWNHKERMVTFKVPHAKRQDVTVLGSQEGAMHSALAGATEVDSGDGNHMFAGHLKCKVRMEKLRIKGMSYTMCSGKFSIDKEMAETQHGTTVVKVKYEGTGAPCKVPIEIRDVNKEKVVGRIISSTPFAENTNSVTNIELEPPFGDSYIVIGVGDSALTLHWFRKGSSIGKMFESTYRGAKRMAILGETAWDFGSVGGLLTSLGKAVHQVFGSVYTTMFGGVSWMVRILIGLLVLWIGTNSRNTSMAMSCIAVGGITLFLGFTVHADMGCVVSWSGKELKCGSGIFVIDNVHTWTEQYKFQPESPARLASAILNAHKEGVCGIRSTTRLENVMWKQITNELNYVLWEGGHDLTVVAGDVKGVLSKGKRALAPPVNDLKYSWKTWGKAKIFTPETRNSTFLVDGPDTSECPNERRAWNFLEVEDYGFGMFTTNIWMKFREGSSEVCDHRLMSAAIKDQKAVHADMGYWIESSKNQTWQIEKASLIEVKTCLWPKTHTLWSNGVLESQMLIPKAYAGPISQHNYRQGYATQTAGPWHLGKLEIDFGECPGTTVTIQEDCDHRGPSLRTTTASGKLVTQWCCRSCTMPPLRFLGEDGCWYGMEIRPLNEKEENMVKSQVSAGQGTSETFSMGLLCLTLFVEECLRRRVTRKHMILVVVTTLCAIILGGLTWMDLLRALIMLGDTMSGRMGGQIHLAIMAVFKMSPGYVLGIFLRKLTSRETALMVIGMAMTTVLSIPHDLMEFIDGISLGLILLKMVTHFDNTQVGTLALALTFIKSTMPLVMAWRTIMAVLFVVTLIPLCRTSCLQKQSHWVEITALILGAQALPVYLMTLMKGASKRSWPLNEGIMAVGLVSLLGSALLKNDVPLAGPMVAGGLLLAAYVMSGSSADLSLEKAANVQWDEMADITGSSPIIEVKQDEDGSFSIRDVEETNMITLLVKLALITVSGLYPLAIPVTMTLWYMWQVKTQRSGALWDVPSPAAAQKATLTEGVYRIMQRGLFGKTQVGVGIHTEGVFHTMWHVTRGSVICHESGRLEPSWADVRNDMISYGGGWRLGDKWDKEEDVQVLAIEPGKNPKHVQTKPGLFKTLTGEIGAVTLDFKPGTSGSPIINRKGKVIGLYGNGVVTKSGDYVSAITQAERIGEPDYEVDEDIFRKKRLTIMDLHPGAGKTKRILPSIVREALKRRLRTLILAPTRVVAAEMEEALRGLPIRYQTPAVKSEHTGREIVDLMCHATFTTRLLSSTRVPNYNLIVMDEAHFTDPSSVAARGYISTRVEMGEAAAIFMTATPPGTTDPFPQSNSPIEDIEREIPERSWNTGFDWITDYQGKTVWFVPSIKAGNDIANCLRKSGKKVIQLSRKTFDTEYPKTKLTDWDFVVTTDISEMGANFRAGRVIDPRRCLKPVILTDGPERVILAGPIPVTPASAAQRRGRIGRNPAQEDDQYVFSGDPLRNDEDHAHWTEAKMLLDNIYTPEGIIPTLFGPEREKTQAIDGEFRLRGEQRKTFVELMRRGDLPVWLSYKVASAGISYKDREWCFTGERNNQILEENMEVEIWTREGEKKKLRPKWLDARVYADPMALKDFKEFASGRKSITLDILTEIASLPMYLSSRAKLALDNIVMLHTTERGGKAYQHALNELPESLETLMLVALLGAMTAGIFLFFMQGKGIGKLSMGLIAIAVASGLLWVAEIQPQWIAASIILEFFLMVLLVPEPEKQRTPQDNQLIYVILTILTIIALVAANEMGLIEKTKTDFGFYQVKAETTILDVDLRPASAWTLYAVATTILTPMLRHTIENTSANLSLAAIANQAAVLMGLGKGWPLHRMDLGVPLLAMGCYSQVNPTTLTASLVMLLVHYAIIGPGLQAKATREAQKRTAAGIMKNPTVDGITVIDLEPISYDPKFEKQLGQVMLLVLCAGQLLLMRTTWAFCEVLTLATGPILTLWEGNPGRFWNTTIAVSTANIFRGSYLAGAGLAFSLIKNAQTPRRGTGTTGETLGEKWKRQLNSLDRKEFEEYKRSGILEVDRTEAKSALKDGSKIKFAVSRGTSKIRWIVERGMVKPKGKVVDLGCGRGGWSYYMATLKNVTEVKGYTKGGPGHEEPVPMATYGWNLVKLHSGVDVFYKPTEQVDTLLCDIGESSSNPTIEEGRTLRVLKMVEPWLSSKPEFCIKVLNPYMPTVIEELEKLQRRHGGSLVRCPLSRNSTHEMYWVSGVSGNIVSSVNTTSKMLLNRFTTRHRKPTYEKDADLGAGTRSVSTETEKPDMTIIGRRLQRLQEEHKETWHYDHENPYRTWAYHGSYEAPSTGSASSMVNGVVKLLTKPWDVVPMVTQLAMTDTTPFGQQRVFKEKVDTRTPQPKPGTRVIMTTTANWLWTLLGRKKNPRLCTREEFISKVRSNAAIGAVFQEEQGWTSASEAVNDSRFWELVDKERALHQEGKCESCVYNMMGKREKKLGEFGRAKGSRAIWYMWLGARFLEFEALGFLNEDHWFGRENSWSGVEGEGLHRLGYILEDIDKKDGDLIYADDTAGWDTRITEDDLLNEELITEQMAPHHKILAKAIFKLTYQNKVVKVLRPTPKGAVMDIISRKDQRGSGQVGTYGLNTFTNMEVQLIRQMEAEGVITQDDMHNPKGLKERVEKWLKECGVDRLKRMAISGDDCVVKPLDERFSTSLLFLNDMGKVRKDIPQWEPSKGWKNWQEVPFCSHHFHKIFMKDGRSLVVPCRNQDELIGRARISQGAGWSLRETACLGKAYAQMWSLMYFHRRDLRLASMAICSAVPTEWFPTSRTTWSIHAHHQWMTTEDMLKVWNRVWIEDNPNMIDKTPVHSWEDIPYLGKREDLWCGSLIGLSSRATWAKNIHTAITQVRNLIGKEEYVDYMPAMRRYSAHFESEGVL

SEQ ID NO: 5150 - protein, 3288 aa, Artificial Sequence
  derived and/or modified protein sequence (wt) from DENV-4__KP188557__SS-prME
STITLLCLIPTVMAFHLSTRDGEPLMIVAKHERGRPLLFKTTEGINKCTLIAMDLGEMCEDTVTYKCPLLVNTEPEDIDCWCNLTSTWVMYGTCTQSGERRREKRSVALTPHSGMGLETRAETWMSSEGAWKHAQRVESWILRNPGFALLAGFMAYMIGQTGIQRTVFFVLMMLVAPSYGMRCVGVGNRDFVEGVSGGAWVDLVLEHGGCVTTMAQGKPTLDFELTKTTAKEVALLRTYCIEALISNITTATRCPTQGEPYLKEEQDQQYICRRDVVDRGWGNGCGLFGKGGVVTCAKFSCSGKITGNLVQIENLEYTVVVTVHNGDTHAVGNDTSNHGVTATITPRSPSVEVKLPDYGELTLDCEPRSGIDFNEMILMKMKKKTWLVHKQWFLDLPLPWTTGADTSEVHWNYKERMVTFKVPHAKRQDVTVLGSQEGAMHSALAGATEVDSGDGNHMFAGHLKCKVRMEKLRIKGMSYTMCSGKFSIDKEMAETQHGTTVVKVKYEGAGAPCKVPIEIRDVNKEKVVGRVISATPLAENTNSVTNIELEPPFGDSYIVIGVGNSALTLHWFRKGSSIGKMFESTYRGAKRMAILGETAWDFGSVGGLFTSLGKAVHQVFGSVYTTMFGGVSWMIRILIGFLVLWIGTNSRNTSMAMTCIAVGGITLFLGFTVQADMGCVVSWSGRELKCGSGIFVVDNVHTWTEQYKFQPESPARLASAILNAHKDGVCGIRSTTRLENVMWKQITNELNYVLWEGGHDLTVVAGDVKGVLTKGKRALTPPASDLKYSWKTWGKARIFTPEARNNTFLIDGPDTSECPNERRAWNSFEVEDYGFGMFTTNIWMKFREGSSEVCDHRLMSAAIKDQKAVHADMGYWIESSKNQTWQIERASLIEVKTCLWPKTHTLWSNGVLESQMLIPKSYAGPFSQHNYRQGYATQTVGPWHLGKLEIDFGECPGTTVTIQENCDHRGPSLRTTTASGKLVTQWCCRSCTMPPLRFLGEDGCWYGMEIRPLSEKEENMVKSQVTAGQGTSETFSMGLLCLTLFVEECLRRRVTRKHMILAVVITLCAIILGGLTWMDLLRALIMLGDTMSGRIGGQTHLAIMAVFKMSPGYVLGVFLRKLTSRETALMVIGMAMTTTLSIPHDLMELIDGISLGLILLKIVTQFDNTQVGTLALSLTFIRSTMSLVMAWRTIMAVLFVVTLIPLCRTSCLQKQSHWVEITALILGAQALPVYLMTLMKGASRRSWPLNEGIMAVGLVSLLGSALLKNDVPLAGPMVAGGLLLAAYVMSGSSADLSLEKAANVRWDEMADITGSSPIIEVKQDEDGSFSIRDVEETNMITLLVKLALITVSGLYPLAIPITMTLWYMWQVKTQRSGALWDVPSPAATQKAALSEGVYRIMQRGLFGKTQVGVGIHMEGVFHTMWHVTRGSVICHETGRLEPSWADVRNDMISYGGGWRLGDKWDKEEDVQVLAIEPGKNPKHVQTKPGLFKTLTGEIGAVTLDFKPGTSGSPIINRKGKVIGLYGNGVVTKSGDYVSAITQAERIGEPDYEVDEDIFRKKRLTIMDLHPGAGKTKRILPSIVREALKRRLRTLILAPTRVVAAEMEEALRGLPIRYQTPAVKSEHTGREIVDLMCHATFTTRLLSSTRVPNYNLIVMDEAHFTDPSSVAARGYISTRVEMGEAAAIFMTATPPGATDPFPQSNSPIEDIEREIPERSWNTGFDWITDYQGKTVWFVPSIKAGNDIANCLRKSGKKVIQLSRKTFDTEYPKTKLTDWDFVVTTDISEMGANFRAGRVIDPRRCLKPVILTDAPERVILAGPIPVTPASAAQRRGRIGRNPAQEDDQYVFSGDPLKNDEDHAHWTEAKMLLDNIYTPEGIIPTLFGPEREKTQAIDGEFRLRGEQRKTFVELMRRGDLPVWLSYKVASAGISYKDREWCFTGERNNQILEENMEVEIWTREGEKKKLRPKWLDARVYADPMALKDFKEFASGRKSITLDILTEIASLPTYLSSRAKLALDNIVMLHTTERGGRAYQHALNELPESLETLMLVALLGAMTAGIFLFFMQGKGIGKLSMGLITIAVASGLLWVAEIQPQWIAASIILEFFLMVLLIPEPEKQRTPQDNQLIYVILTILTIIGLIAANEMGLIEKTKTDFGFYQVKTETTILDVDLRPASAWTLYAVATTILTPMLRHTIENTSANLSLAAIANQAAVLMGLGKGWPLHRMDLGVPLLAMGCYSQVNPTTLTASLVMLLVHYAIIGPGLQAKATREAQKRTAAGIMKNPTVDGITVIDLEPISYDPKFEKQLGQVMLLVLCAGQLLLMRTTWAFCEVLTLATGPILTLWEGNPGRFWNTTIAVSTANIFRGSYLAGAGLAFSLIKNAQTPRRGTGTAGETLGEKWKRQLNSLDRKEFEEYKRSGILEVDRTEAKSALKDGSKIKHAVSRGSSKIRWIVERGMVKPKGKVVDLGCGRGGWSYYMATLKNVTEVKGYTKGGPGHEEPIPMATYGWNLVKLHSGVDVFYKPTEQVDTLLCDIGESSSNPTIEEGRTLRVLKMVEPWLSSKPEFCIKVLNPYMPTVIEELEKLQRKHGGNLVRCPLSRNSTHEMYWVSGASGNIVSSVNTTSKMLLNRFTTRHRKPTYEKDVDLGAGTRSVSTETEKPDMTIIGRRLQRLQEEHKETWHYDQENPYRTWAYHGSYEAPSTGSASSMVNGVVKLLTKPWDVIPMVTQLAMTDTTPFGQQRVFKEKVDTRTPQPKPGTRMVMTTTANWLWALLGKKKNPRLCTREEFISKVRSNAAIGAVFQEEQGWTSASEAVNDSRFWELVDKERALHQEGKCESCVYNMMGKREKKLGEFGRAKGSRAIWYMWLGARFLEFEALGFLNEDHWFGRENSWSGVEGEGLHRLGYILEEIDKKDGDLMYADDTAGWDTRITEDDLQNEELITEQMAPHHKILAKAIFKLTYQNKVVKVLRPTPRGAVMDIISRKDQRGSGQVGTYGLNTFTNMEVQLIRQMEAEGVITQDDMQNPKGLKERVEKWLRECGVDRLKRMAISGDDCVVKPLDERFGTSLLFLNDMGKVRKDIPQWEPSKGWKNWQEVPFCSHHFHKIFMKDGRSLVVPCRNQDELIGRARISQGAGWSLRETACLGKAYAQMWSLMYFHRRDLRLASMAICSAVPTEWFPTSRTTWSIHAHHQWMTTEDMLKVWNRVWIEDNPNMIDKTPVHSWEDIPYLGKREDLWCGSLIGLSSRATWAKNIHTAITQVRNLIGKEEYVDYMPVMKRYSAPSESEGVL

SEQ ID NO: 5151 - protein, 3288 aa, Artificial Sequence
  derived and/or modified protein sequence (wt) from DENV-4__KP188558__SS-prME
STITLLCLIPTVMAFHLSTRDGEPLMIVAKHERGRPLLFKTTEGINKCTLIAMDLGEMCEDTVTYKCPLLVNTEPEDIDCWCNLTSTWVMYGTCTQSGERRREKRSVALTPHSGMGLETRAETWMSSEGAWKHAQRVESWILRNPGFALLAGFMAYMIGQTGIQRTVFFVLMMLVAPSYGMRCVGVGNRDFVEGVSGGAWVDLVLEHGGCVTTMAQGKPTLDFELTKTTAKEVALLRTYCIEALISNITTATRCPTQGEPYLKEEQDQQYICRRDVVDRGWGNGCGLFGKGGVVTCAKFSCSGKITGNLVQIENLEYTVVVTVHDGDTHAVGNDTSNHGVTATITPRSPSVEVKLPDYGELTLDCEPRSGIDFNEMILMKMKKKTWLVHKQWFLDLPLPWTTGADTSEVHWNYKERMVTFKVPHAKRQDVTVLGSQEGAMHSALAGATEVDSGDGNHMFAGHLKCKVRMEKLRIKGMSYTMCSGKFSIDKEMAETQHGTTVVKVKYEGAGAPCKVPIEIRDVNKEKVVGRVISATPLAENTNSVTNIELEPPFGDSYIVIGVGNSALTLHWFRKGSSIGKMFESTYRGAKRMAILGETAWDFGSVGGLFTSLGKAVHQVFGSVYTTMFGGVSWMIRILIGFLVLWIGTNSRNTSMAMTCIAVGGITLFLGFTVQADMGCVVSWSGRELKCGSGIFVVDNVHTWTEQYKFQPESPARLASAILNAHKDGVCGIRSTTRLENVMWKQITNELNYVLWEGGHDLTVVAGDVKGVLTKGKRALTPPASDLKYSWKTWGKAKIFTPEARNSTFLIDGPDTSECPNERRAWNSFEVEDYGFGMFTTNIWMKFREGSSEVCDHRLMSAAIKDQKAVHADMGYWIESSKNQTWQIERASLIEVKTCLWPKTHTLWSNGVLESQMLIPKSYAGPFSQHNYRQGYATQTVGPWHLGKLEIDFGECPGTTVTIQENCDHRGPSLRTTTASGKLVTQWCCRSCTMPPLRFLGEDGCWYGMEIRPLSEKEENMVKSQVTAGQGTSETFSMGLLCLTLFVEECLRRRVTRKHMILAVVITLCAIILGGLTWMDLLRALIMLGDTMSGRIGGQTHLAIMAVFKMSPGYVLGVFLRKLTSRETALMVIGMAMTTTLSIPHDLMELIDGISLGLILLKIVTQFDNTQVGTLALSLTFIRSTISLVMAWRTIMAVLFVVTLIPLCRTSCLQKQSHWVEITALILGAQALPVYLMTLMKGASRRSWPLNEGIMAVGLVSLLGSALLKNDVPLAGPMVAGGLLLAAYVMSGSSADLSLEKAANVQWDEMADITGSSPIIEVKQDEDGSFSIRDVEETNMITLLVKLALITVSGLYPLAIPITMTLWYMWQVKTQRSGALWDVPSPAATQKAALSEGVYRIMQRGLFGKTQVGVGIHMEGVFHTMWHVTRGSVICHETGRLEPSWADVRNDMISYGGGWRLGDKWDKEEDVQVLAIEPGKNPKHVQTKPGLFKTLTGEIGAVTLDFKPGTSGSPIINRKGKVIGLYGNGVVTKSGDYVSAITQAERIGEPDYEVDEDIFRKKRLTIMDLHPGAGKTKRILPSIVREALKRRLRTLILAPTRVVAAEMEEALRGLPIRYQTPAVKSEHTGREIVDLMCHATFTTRLLSSTRVPNYNLIVMDEAHFTDPSSVAARGYISTRVEMGEAAAIFMTATPPGATDPFPQSNSPIEDIEREIPERSWNTGFDWITDYQGKTVWFVPSIKAGNDIANCLRKSGKKVIQLSRKTFDTEYPKTKLTDWDFVVTTDISEMGANFRAGRVIDPRRCLKPVILTDGPERVILAGPIPVTPASAAQRRGRIGRNPAQEDDQYVFSGDPLKNDEDHAHWTEAKMLLDNIYTPEGIIPTLFGPEREKTQAIDGEFRLRGEQRKTFVELMRRGDLPVWLSYKVASAGISYKDREWCFTGERNNQILEENMEVEIWTREGEKKKLRPKWLDARVYADPMALKDFKEFASGRKSITLDILTEIASLPTYLSSRAKLALDNIVMLHTTERGGRAYQHALNELPESLETLMLVALLGAMTAGIFLFFMQGKGIGKLSMGLITIAVASGLLWVAEIQPQWIAASIILEFFLMVLLIPEPEKQRTPQDNQLIYVILTILTIIGLIAANEMGLIEKTKTDFGFYQVKTETTILDVDLRPASAWTLYAVATTILTPMLRHTIENTSANLSLAAIANQAAVLMGLGKGWPLHRMDLGVPLLAMGCYSQVNPTTLTASLVMLLVHYAIIGPGLQAKATREAQKRTAAGIMKNPTVDGITVIDLEPISYDPKFEKQLGQVMLLVLCAGQLLLMRTTWAFCEVLTLATGPILTLWEGNPGRFWNTTIAVSTANIFRGSYLAGAGLAFSLIKNAQTPRRGTGTAGETLGEKWKRQLNSLDRKEFEEYKRSGILEVDRTEAKSALKDGSKIKHAVSRGSSKIRWIVERGMVKPKGKVVDLGCGRGGWSYYMATLKNVTEVKGYTKGGPGHEEPIPMATYGWNLVKLHSGVDVFYKPTEQVDTLLCDIGESSSNPTIEEGRTLRVLKMVEPWLSSKPEFCIKVLNPYMPTVIEELEKLQRKHGGNLVRCPLSRNSTHEMYWVSGASGNIVSSVNTTSKMLLNRFTTRHRKPTYEKDVDLGAGTRSVSTETEKPDMTIIGRRLQRLQEEHKETWHYDQENPYRTWAYHGSYEAPSTGSASSMVNGVVKLLTKPWDVIPMVTQLAMTDTTPFGQQRVFKEKVDTRTPQPKPGTRMVMTTTANWLWALLGKKKNPRLCTREEFISKVRSNAAIGAVFQEEQGWTSASEAVNDSRFWELVDKERALHQEGKCESCVYNMMGKREKKLGEFGRAKGSRAIWYMWLGARFLEFEALGFLNEDHWFGRENSWSGVEGEGLHRLGYILEEIDKKDGDLMYADDTAGWDTRITEDDLQNEELITEQMAPHHKILAKAIFKLTYQNKVVKVLRPTPRGAVMDIISRKDQRGSGQVGTYGLNTFTNMEVQLIRQMEAEGVITQDDMQNPKGLKERVEKWLRECGVDRLKRMAISGDDCVVKPLDERFGTSLLFLNDMGKVRKDIPQWEPSKGWKNWQEVPFCSHHFHKIFMKDGRSLVVPCRNQDELIGRARISQGAGWSLRETACLGKAYAQMWSLMYFHRRDLRLASMAICSAVPTEWFPTSRTTWSIHAHHQWMTTEDMLKVWNRVWIEDNPNMIDKTPVHSWEDIPYLGKREDLWCGSLIGLSSRATWAKNIHTAITQVRNLIGKEEYVDYMPVMKRYSAPSESEGVL

SEQ ID NO: 5152 - protein, 3288 aa, Artificial Sequence
  derived and/or modified protein sequence (wt) from DENV-4__KP188563__SS-prME
STITLLCLIPTVMAFHLSTRDGEPLMIVAKHERGRPLLFKTTEGINKCTLIAMDLGEMCEDTVTYKCPLLVNTEPEDIDCWCNLTSTWVMYGTCTQSGERRREKRSVALTPHSGMGLETRAETWMSSEGAWKHAQRVESWILRNPGFALLAGFMAYMIGQTGIQRTVFFVLMMLVAPSYGMRCVGVGNRDFVEGVSGGAWVDLVLEHGGCVTTMAQGKPTLDFELTKTTAKEVALLRTYCIEALISNITTATRCPTQGEPYLKEEQDQQYICRRDVVDRGWGNGCGLFGKGGVVTCAKFSCSGKITGNLVQIENLEYTVVVTVHNGDTHAVGNDTSNHGVTATITPRSPSVEVKLPDYGELTLDCEPRSGIDFNEMILMKMKKKTWLVHKQWFLDLPLPWTTGADTSEVHWNYKERMVTFKVPHAKRQDVTVLGSQEGAMHSALAGATEVDSGDGNHMFAGHLKCKVRMEKLRIKGMSYTMCSGKFSIDKEMAETQHGTTVVKVKYEGAGAPCKVPIEIRDVNKEKVVGRVISATPLAENTNSVTNIELEPPFGDSYIVIGVGNSALTLHWFRKGSSIGKMFESTYRGAKRMAILGETAWDFGSVGGLFTSLGKAVHQVFGSVYTTMFGGVSWMIRILIGFLVLWIGTNSRNTSMAMTCIAVGGITLFLGFTVQADMGCVVSWSGRELKCGSGIFVVDNVHTWTEQYKFQPESPARLASAILNAHKDGVCGIRSTTRLENVMWKQITNELNYVLWEGGHDLTVVAGDVKGVLTKGKRALTPPASDLKYSWKTWGKAKIFTPEARNSTFLIDGPDTSECPNERRAWNSFEVEDYGFGMFTTNIWMKFREGSSEVCDHRLMSAAIKDQKAVHADMGYWIESSKNQTWQIERASLIEVKTCLWPKTHTLWSNGVLESQMLIPKSYAGPFSQHNYRQGYATQTVGPWHLGKLEIDFGECPGTTVTIQENCDHRGPSLRTTTASGKLVTQWCCRSCTMPPLRFLGEDGCWYGMEIRPLSEKEENMVKSQVTAGQGTSETFSMGLLCLTLFVEECLRRRVTRKHMILAVVITLCAIILGGLTWMDLLRALIMLGDTMSGRIGGQTHLAIIAVFKMSPGYVLGVFLRKLTSRETALMVIGMAMTTTLSIPHDLMELIDGISLGLILLKIVTQFDNTQVGTLALSLTFIRSTMSLVMAWRTIMAVLFVVTLIPLCRTSCLQKQSHWVEITALILGAQALPVYLMTLMKGASRRSWPLNEGIMAVGLVSLLGSALLKNDVPLAGPMVAGGLLLAAYVMSGSSADLSLEKAANVQWDEMADITGSSPIIEVKQDEDGSFSIRDVEETNMITLLVKLALITVSGLYPLAIPITMTLWYMWQVKTQRSGALWDVPSPAATQKAALSEGVYRIMQRGLFGKTQVGVGIHMEGVFHTMWHVTRGSVICHETGRLEPSWADVRNDMISYGGGWRLGDKWDREEDVQVLAIEPGKNPKHVQTKPGLFKTLTGEIGAVTLDFKPGTSGSPIINRKGKVIGLYGNGVVTKSGDYVSAITQAERIGEPDYEVDEDIFRKKRLTIMDLHPGAGKTKRILPSIVREALKRRLRTLILAPTRVVAAEMEEALRGLPIRYQTPAVKSEHTGREIVDLMCHATFTTRLLSSTRVPNYNLIVMDEAHFTDPSSVAARGYISTRVEMGEAAAIFMTATPPGATDPFPQSNSPIEDIEREIPERSWNTGFDWITDYQGKTVWFVPSIKAGNDIANCLRKSGKKVIQLSRKTFDTEYPKTKLTDWDFVVTTDISEMGANFRAGRVIDPRRCLKPVILTDGPERVILAGPIPVTPASAAQRRGRIGRNPAQEDDQYVFSGDPLKNDEDHAHWTEAKMLLDNIYTPEGIIPTLFGPEREKTQAIDGEFRLRGEQRKTFVELMRRGDLPVWLSYKVASAGISYKDREWCFTGERNNQILEENMEVEIWTREGEKKKLRPKWLDARVYADPMALKDFKEFASGRKSITLDILTEIASLPTYLSSRAKLALDNIVMLHTTERGGRAYQHALNELPESLETLMLVALLGAMTAGIFLFFMQGKGIGKLSMGLITIAVASGLLWVAEIQPQWIAASIILEFFLMVLLIPEPEKQRTPQDNQLIYVILTILTIIGLIAANEMGLIEKTKTDFGFYQVKTETTILDVDLRPASAWTLYAVATTILTPMLRHTIENTSANLSLAAIANQAAVLMGLGKGWPLHRMDLGVPLLAMGCYSQVNPTTLTASLVMLLVHYAIIGPGLQAKATREAQKRTAAGIMKNPTVDGITVIDLEPISYDPKFEKQLGQVMLLVLCAGQLLLMRTTWAFCEVLTLATGPILTLWEGNPGRFWNTTIAVSTANIFRGSYLAGAGLAFSLIKNAQTPRRGTGTAGETLGEKWKRQLNSLDRKEFEEYKRSGILEVDRTEAKSALKDGSKIKHAVSRGSSKIRWIVERGMVKPKGKVVDLGCGRGGWSYYMATLKNVTEVKGYTKGGPGHEEPIPMATYGWNLVKLHSGVDVFYKPTEQVDTLLCDIGESSSNPTIEEGRTLRVLKMVEPWLSSKPEFCIKVLNPYMPTVIEELEKLQRKHGGNLVRCPLSRNSTHEMYWVSGASGNIVSSVNTTSKMLLNRFTTRHRKPTYEKDVDLGAGTRSVSTEIEKPDMTIIGRRLQRLQEEHKETWHYDQENPYRTWAYHGSYEAPSTGSASSMVNGVVKLLTKPWDVIPMVTQLAMTDTTPFGQQRVFKEKVDTRTPQPKPGTRMVMTTTANWLWALLGKKKNPRLCTREEFISKVRSNAAIGAVFQEEQGWTSASEAVNDSRFWELVDKERALHQEGKCESCVYNMMGKREKKLGEFGRAKGSRAIWYMWLGARFLEFEALGFLNEDHWFGRENSWSGVEGEGLHRLGYILEEIDKKDGDLMYADDTAGWDTRITEDDLQNEELITEQMAPHHKILAKAIFKLTYQNKVVKVLRPTPRGAVMDIISRKDQRGSGQVGTYGLNTFTNMEVQLIRQMEAEGVITQDDMQNPKGLKERVEKWLRECGVDRLKRMAISGDDCVVKPLDERFGTSLLFLNDMGKVRKDIPQWEPSKGWKNWQEVPFCSHHFHKIFMKDGRSLVVPCRNQDELIGRARISQGAGWSLRETACLGKAYAQMWSLMYFHRRDLRLASMAICSAVPTEWFPTSRTTWSIHAHHQWMTTEDMLKVWNRVWIEDNPNMIDKTPVHSWEDIPYLGKREDLWCGSLIGLSSRATWAKNIHTAITQVRNLIGKEEYVDYMSVMKRYSAPSESEGVL

SEQ ID NO: 5153 - protein, 3288 aa, Artificial Sequence
  derived and/or modified protein sequence (wt) from DENV-4__KP188564__SS-prME
STITLLCLIPTVMAFHLSTRDGEPLMIVAKHERGRPLLFKTTEGINKCTLIAMDLGEMCEDTVTYKCPLLVNTEPEDIDCWCNLTSTWVMYGTCTQSGERRREKRSVALTPHSGMGLETRAETWMSSEGAWKHAQRVESWILRNPGFALLAGFMAYMIGQTGIQRTVFFVLMMLVAPSYGMRCVGVGNRDFVEGVSGGAWVDLVLEHGGCVTTIAQGKPTLDFELTKTTAKEVALLRTYCIEALISNITTATRCPTQGEPYLKEEQDQQYICRRDVVDRGWGNGCGLFGKGGVVTCAKFSCSGKITGNLVQIENLEYTVVVTVHNGDTHAVGNDTSNHGVTATITPRSPSVEVKLPDYGELTLDCEPRSGIDFNEMILMKMKKKTWLVHKQWFLDLPLPWTTGADTSEVHWNYKERMVTFKVPHAKRQDVTVLGSQEGAMHSALAGATEVDSGDGNHMFAGHLKCKVRMEKLRIKGMSYTMCSGKFSIDKEMAETQHGTTVVKIKYEGAGAPCKVPIEIRDVNKEKVVGRVISATPLAENTNSVTNIELEPPFGDSYIVIGVGNSALTLHWFRKGSSIGKMFESTYRGAKRMAILGETAWDFGSVGGLFTSLGKAVHQVFGSVYTTMFGGVSWMIRILIGFLVLWIGTNSRNTSMAMTCIAVGGITLFLGFTVQADMGCVVSWSGRELKCGSGIFVVDNVHTWTEQYKFQPESPARLASAILNAHKDGVCGIRSTTRLENVMWKQITNELNYVLWEGGHDLTVVAGDVKGVLTKGKRALTPPASDLKYSWKTWGKAKIFTPEARNSTFLIDGPDTSECPNERRAWNSFEVEDYGFGMFTTNIWMKFREGSSEVCDHRLMSAAIKDQKAVHADMGYWIESSKNQTWQIERASLIEVKTCLWPKTHTLWSNGVLESQMLIPKSYAGPFSQHNYRQGYATQTVGPWHLGKLEIDFGECPGTTVTIQENCDHRGPSLRTTTASGKLVTQWCCRSCTMPPLRFLGEDGCWYGMEIRPLSEKEENMVKSQVTAGQGTSETFSMGLLCLTLFVEECLRRRVTRKHMILAVVITLCAIILGGLTWMDLLRALIMLGDTMSGRIGGQTHLAIMAVFKMSPGYVLGVFLRKLTSRETALMVIGMAMTTTLSIPHDLMELIDGISLGLILLKIVTQFDNTQVGTLALSLTFIRSTMSLVMAWRTIMAVLFVVTLIPLCRTSCLQKQSHWVEITALILGAQALPVYLMTLMKGASRRSWPLNEGIMAVGLVSLLGSALLKNDVPLAGPMVAGGLLLAAYVMSGSSADLSLEKAANVQWDEMADITGSSPIIEVKQDEDGSFSIRDVEETNMITLLVKLALITVSGLYPLAIPITMTLWYMWQVKTQRSGALWDVPSPAATQKAALSEGVYRIMQRGLFGKTQVGVGIHMEGVFHTMWHVTRGSVICHETGRLEPSWADVRNDMISYGGGWRLGDKWDKEEDVQVLAIEPGKNPKHVQTKPGLFKTLTGEIGAVTLDFKPGTSGSPIINRKGKVIGLYGNGVVTKSGDYVSAITQAERIGEPDYEVDEDIFRKKRLTIMDLHPGAGKTKRILPSIVREALKRRLRTLILAPTRVVAAEMEEALRGLPIRYQTPAVKSEHTGREIVDLMCHATFTTRLLSSTRVPNYNLIVMDEAHFTDPSSVAARGYISTRVEMGEAAAIFMTATPPGATDPFPQSNSPIEDIEREIPERSWNTGFDWITDYQGKTVWFVPSIKAGNDIANCLRKSGKKVIQLSRKTFDTEYPKTKLTDWDFVVTTDISEMGANFRAGRVIDPRRCLKPVILTDGPERVILAGPIPVTPASAAQRRGRIGRNPAQEDDQYVFSGDPLKNDEDHAHWTEAKMLLDNIYTPEGIIPTLFGPEREKTQAIDGEFRLRGEQRKTFVELMRRGDLPVWLSYKVASAGISYKDREWCFTGERNNQILEENMEVEIWTREGEKKKLRPKWLDARVYADPMALKDFKEFASGRKSITLDILTEIASLPTYLSSRAKLALDNIVMLHTTERGGRAYQHALNELPESLETLMLVALLGAMTAGIFLFFMQGKGIGKLSMGLITIAVASGLLWVAEIQPQWIAASIILEFFLMVLLIPEPEKQRTPQDNQLIYVILTILTIIGLIAANEMGLIEKTKTDFGFYQVKTETTILDVDLRPASAWTLYAVATTILTPMLRHTIENTSANLSLAAIANQAAVLMGLGKGWPLHRMDLGVPLLAMGCYSQVNPTTLTASLVMLLVHYAIIGPGLQAKATREAQKRTAAGIMKNPTVDGITVIDLEPISYDPKFEKQLGQVMLLVLCAGQLLLMRTTWAFCEVLTLATGPTLTLWEGNPGRFWNTTIAVSTANIFRGSYLAGAGLAFSLIKNAQTPRRGTGTAGETLGEKWKRQLNSLDRKEFEEYKRSGILEVDRTEAKSALKDGSKIKHAVSRGSSKIRWIVERGMVKPKGKVVDLGCGRGGWSYYMATLKNVTEVKGYTKGGPGHEEPIPMATYGWNLVKLHSGVDVFYKPTEQVDTLLCDIGESSSNPTIEEGRTLRVLKMVEPWLSSKPEFCIKVLNPYMPTVIEELEKLQRKHGGNLVRCPLSRNSTHEMYWVSGASGNIVSSVNTTSKMLLNRFTTRHRKPTYEKDVDLGAGTRSVSTETEKPDMTIIGRRLQRLQEEHKETWHYDQENPYRTWAYHGSYEAPSTGSASSMVNGVVKLLTKPWDVIPMVTQLAMTDTTPFGQQRVFKEKVDTRTPQPKPGTRMVMTTTANWLWALLGKKKNPRLCTREEFISKVRSNAAIGAVFQEEQGWTSANEAVNDSRFWELVDKERALHQEGKCESCVYNMMGKREKKLGEFGRAKGSRAIWYMWLGARFLEFEALGFLNEDHWFGRENSWSGVEGEGLHRLGYILEEIDKKDGDLMYADDTAGWDTRITEDDLQNEELITEQMAPHHKILAKAIFKLTYQNKVVKVLRPTPRGAVMDIISRKDQRGSGQVGTYGLNTFTNMEVQLIRQMEAEGVITQDDMQNPKGLKERVEKWLRECGVDRLKRMAISGDDCVVKPLDERFGTSLLFLNDMGKVRKDIPQWEPSKGWKNWQEVPFCSHHFHKIFMKDGRSLVVPCRNQDELIGRARISQGAGWSLRETACLGKAYAQMWSLMYFHRRDLRLASMAICSAVPTEWFPTSRTTWSIHAHHQWMTTEDMLKVWNRVWIEDNPNMIDKTPVHSWEDIPYLGKREDLWCGSLIGLSSRATWAKNIHTAITQVRNLIGKEEYVDYMPVMKRYSAPSESEGVL

SEQ ID NO: 5154 - protein, 3288 aa, Artificial Sequence
  derived and/or modified protein sequence (wt) from DENV-4__JN983813__SS-prME
STITLLCLIPTVMAFHLSTRDGEPLMIVAKHERGRPLLFKTTEGINKCTLIAMDLGEMCEDTVTYKCPLLVNTEPEDIDCWCNLTSTWVMYGTCTQSGERRREKRSVALTPHSGMGLETRAETWMSSEGAWKHAQRVESWILRNPGFALLAGFMAYMIGQTGIQRTVFFVLMMLVAPSYGMRCVGVGNRDFVEGVSGGAWVDLVLEHGGCVTTMAQGKPTLDFELTKTTAKEVALLRTYCIEALISNITTATRCPTQGEPYLKEEQDQQYICRRDVVDRGWGNGCGLFGKGGVVTCAKFSCSGKITGNLVQIENLEYTVVVTVHNGDTHAVGNDTSNHGVTATITPRSPSVEVKLPDYGELTLDCEPRSGIDFNEMILMKMKKKTWLVHKQWFLDLPLPWTTGADTSEVHWNYKERMVTFKVPHAKRQDVTVLGSQEGAMHSALAGATEVDSGDGNHMFAGHLKCKVRMEKLRIKGMSYTMCSGKFSIDKEMAETQHGTTVVKVKYEGAGAPCKVPIEIRDVNKEKVVGRVISATPLAENTNSVTNIELEPPFGDSYIVIGVGNSALTLHWFRKGSSIGKMFESTYRGAKRMAILGETAWDFGSVGGLFTSLGKAVHQVFGSVYTTMFGGVSWMIRILIGFLVLWIGTNSRNTSMAMTCIAVGGITLFLGFTVQADMGCVVSWSGRELKCGSGIFVVDNVHTWTEQYKFQPESPARLASAILNAHKDGVCGIRSTTRLENVMWKQITNELNYVLWEGGHDLTVVAGDVKGVLTKGKRALTPPASDLKYSWKTWGKAKIFTPEARNSTFLIDGPDTSECPNERRAWNSFEVEDYGFGMFTTNIWMKFREGSSEVCDHRLMSAAIKDQKAVHADMGYWIESSKNQTWQIERASLIEVKTCLWPKTHTLWSNGVLESQMLIPKSYAGPFSQHNYRQGYATQTVGPWHLGKLEIDFGECPGTTVTIQENCDHRGPSLRTTTASGKLVTQWCCRSCTMPPLRFLGEDGCWYGMEIRPLSEKEENMVKSQVTAGQGTSETFSMGLLCLTLFVEECLRRRVTRKHMILAVVITLCAIILGGLTWMDLLRALIMLGDTMSGRIGGQTHLAIMAVFKMSPGYVLGVFLRKLTSRETALMVIGMAMTTTLSIPHDLMELIDGISLGLILLKIVTQFDNTQVGTLALSLTFIRSTMSLVMAWRTIMAVLFVVTLIPLCRTSCLQKQSHWVEITALILGAQALPVYLMTLMKGASRRSWPLNEGIMAVGLVSLLGSALLKNDVPLAGPMVAGGLLLAAYVMSGSSADLSLEKAANVQWDEMADITGSSPIIEVKQDEDGSFSIRDVEETNMITLLVKLALITVSGLYPLAIPITMTLWYMWQVKTQRSGALWDVPSPAATQKAALSEGVYRIMQRGLFGKTQVGVGIHMEGVFHTMWHVTRGSVICHETGRLEPSWADVRNDMISYGGGWRLGDKWDKEEDVQVLAIEPGKNPKHVQTKPGLFKTLTGEIGAVTLDFKPGTSGSPIINRKGKVIGLYGNGVVTKSGDYISAITQAERIGEPDYEVDEDIFRKKRLTIMDLHPGAGKTKRILPSIVREALKRRLRTLILAPTRVVAAEMEEALRGLPIRYQTPAVKSEHTGREIVDLMCHATFTTRLLSSTRVPNYNLIVMDEAHFTDPSSVAARGYISTRVEMGEAAAIFMTATPPGATDPFPQSNSPIEDIEREIPERSWNTGFDWITDYQGKTVWFVPSIKAGNDIANCLRKSGKKVIQLSRKTFDTEYPKTKLTDWDFVVTTDISEMGANFRAGRVIDPRRCLKPVILTDGPERVILAGPIPVTPASAAQRRGRIGRNPAQEDDQYVFSGDPLKNDEDHAHWTEAKMLLDNIYTPEGIIPTLFGPEREKTQAIDGEFRLRGEQRKTFVELMRRGDLPVWLSYKVASAGISYKDREWCFTGERNNQILEENMEVEIWTREGEKKKLRPKWLDARVYADPMALKDFKEFASGRKSITLDILTEIASLPTYLSSRAKLALDNIVMLHTTERGGRAYQHALNELPESLETLMLVALLGAMTAGIFLFFMQGKGIGKLSMGLITIAVASGLLWVAEIQPQWIAASIILEFFLMVLLIPEPEKQRTPQDNQLIYVILTILTIIGLIAANEMGLIEKTKTDFGFYQVKTETTILDVDLRPASAWTLYAVATTILTPMLRHTIENTSANLSLAAIANQAAVLMGLGKGWPLHRMDLGVPLLAMGCYSQVNPTTLTASLVMLLVHYAIIGPGLQAKATREAQKRTAAGIMKNPTVDGITVIDLEPISYDPKFEKQLGQVMLLVLCAGQLLLMRTTWAFCEVLTLATGPILTLWEGNPGRFWNTTIAVSTANIFRGSYLAGAGLAFSLIKNAQTPRRGTGTAGETLGEKWKRQLNSLDRKEFEEYKRSGILEVDRTEAKSALKDGSKIKHAVSRGSSKIRWIVERGMVKPKGKVVDLGCGRGGWSYYMATLKNVTEVKGYTKGGPGHEEPIPMATYGWNLVKLHSGVDVFYKPTEQVDTLLCDIGESSSNPTIEEGRTLRVLKMVEPWLSSKPEFCIKVLNPYMPTVIEELEKLQRKHGGNLVRCPLSRNSTHEMYWVSGASGNIVSSVNTTSKMLLNRFTTRHRKPTYEKDVDLGAGTRSVSTETEKPDMTIIGRRLQRLQEEHKETWHYDQENPYRTWAYHGSYEAPSTGSASSMVNGVVKLLTKPWDVIPMVTQLAMTDTTPFGQQRVFKEKVDTRTPQPKPGTRMVMTTTANWLWALLGKKKNPRLCTREEFISKVRSNAAIGAVFQEEQGWTSASEAVNDSRFWELVDKERALHQEGKCESCVYNMMGKREKKLGEFGRAKGSRAIWYMWLGARFLEFEALGFLNEDHWFGRENSWSGVEGEGLHRLGYILEEIDKKDGDLMYADDTAGWDTRITEDDLQNEELITEQMAPHHKILAKAIFKLTYQNKVVKVLRPTPRGAVMDIISRKDQRGSGQVGTYGLNTFTNMEVQLIRQMEAEGVITQDDMQNPKGLKERVEKWLRECGVDRLKRMAISGDDCVVKPLDERFGTSLLFLNDMGKVRKDIPQWEPSKGWKNWQEVPFCSHHFHKIFMKDGRSLVVPCRNQDELIGRARISQGAGWSLRETACLGKAYAQMWSLMYFHRRDLRLASMAICSAVPTEWFPTSRTTWSIHAHHQWMTTEDMLKVWNRVWIEDNPNMIDKTPVHSWEDIPYLGKREDLWCGSLIGLSSRATWAKNIHTAITQVRNLIGKEEYVDYMPVMKRYSAPSESEGVL

SEQ ID NO: 5155 - protein, 3288 aa, Artificial Sequence
  derived and/or modified protein sequence (wt) from DENV-4__KF041260__SS-prME
STITLLCLIPTVMAFHLSTRDGEPLMIVAKHERGRPLLFKTTEGINKCTLIAMDLGEMCEDTVTYKCPLLVNTEPEDIDCWCNLTSAWVMYGTCTQSGERRREKRSVALTPHSGMGLETRAETWMSSEGAWKHAQRVESWILRNPGFALLAGFMAYMIGQTGIQRTVFFILMMLVAPSYGMRCVGVGNRDFVEGVSGGAWVDLVLEHGGCVTTMAQGKPTLDFELIKTTAKEVALLRTYCIEASISNITTATRCPTQGEPYLKEEQDQQYICRRDVVDRGWGNGCGLFGKGGVVTCAKFSCSGKITGNLIQIENLEYTVVVTVHNGDTHAVGNDTSNHGVTATVTPRSPSVEVELPDYGELTLDCEPRSGIDFNEMILMKMNKKTWLVHKQWFLDLPLPWTAGADTSEVHWNHKERMVTFKVPHAKRQDVTVLGSQEGAMHSALTGATEVDSGDGNHMFAGHLKCKVRMEKLRIKGMSYTMCSGKFSIDKEMAETQHGTTVVKVKYEGAGAPCKVPIEIRDVNKEKVVGRIISSTPFAENTNSVTNIELEPPFGDSYIVIGVGDSALTLHWFRKGSSIGKMFESTYRGAKRMAILGETAWDFGSVGGLLTSLGKAVHQVFGSVYTTMFGGVSWMVRILIGFLVLWIGTNSRNTSMAMSCIAVGGITLFLGFTVHADMGCAVSWSGKELKCGSGIFIIDNVHTWTEQYKFQPESPARLASAILNAHKDGVCGIRSTTRLENVMWKQITNELNYVLWEGGHDLTVVAGDVKGVLSKGKRALAPPVNDLKYSWKTWGKAKIFTPETRNSTFLIDGPDTSECPNERRAWNFLEVEDYGFGMFTTNIWMKFREGSSEVCDHRLMSAAIKDQKAVHADMGYWIESSKNQTWQIEKASLIEVKTCLWPKTHTLWSNGVLESQMLIPKAYAGPFSQHNYRQGYATQTMGPWHLGKLEIDFGECPGTTVTIQEDCDHRGPSLRTTTASGKLVTQWCCRSCTMPPLRFLGEDGCWYGMEIRPLSEKEENMVKSQVSAGQGTSETFSMGLLCLTLFVEECLRRRVTRKHMILVVVTTLCAIILGGLTWMDLLRALIMLGNTMSSRMGGQTHLAIMAVFKMSPGYVLGIFLRKLTSRETALMVIGMAMTTVLSIPHDLMEFIDGISLGLILLKMVTHFDNTQVGTLALSLTFIKSTMPLVMAWRTIMAVLFVVTLIPLCRTSCLQKQSHWVEITALILGAQALPVYLMTLMKGASKRSWPLNEGIMAVGLVSLLGSALLKNDVPLAGPMVAGGLLLAAYVMSGSSADLSLEKAATVQWDEMADITGSSPIIEVKQDEDGSFSIRDVEETNMITLLVKLALITVSGLYPLAIPVTMTLWYMWQVKTQRSGALWDVPSPAATQKATLTEGVYRIMQRGLFGKTQVGVGIHMEGVFHTMWHVTRGSVICHESGRLEPSWADVKNDMISYGGGWRLGDKWDKEEDVQVLAVEPGKNPKHVQTKPGLFKTLTGEIGAVTLDFKPGTSGSPIINRKGKVIGLYGNGVVTKSGDYVSAITQAERIGEPDYEVDEDIFRKKRLTIMDLHPGAGKTKRILPSIVREALKRRLRTLILAPTRVVAAEMEEALRGLPIRYQTPAVKTEHTGREIVDLMCHATFTTRLLSSTRVPNYNLIVMDEAHFTDPSSVAARGYISTRVEMGEAAAIFMTATPPGTTDPFPQSNSPIEDIEREIPERSWNTGFDWITDYQGKTVWFVPSIKAGNDIANCLRKSGKKVVQLSRKTFDTEYPKTKLTDWDFVVTTDISEMGANFRAGRVIDPRRCLKPVIITDGPERVILAGPIPVTPASAAQRRGRIGRNPAQEDDQYVFSGDPLRNDEDHAHWTEAKMLLDNIHTPEGIIPTLFGPEREKTQAIDGEFRLRGEQRKTFVELMRRGDLPVWLSYKVASAGISYKDREWCFTGERNNQILEENMEVEIWTREGEKKKLRPKWLDARVYADPVALKDFKEFASGRKSITLDILTEIASLPTYLSSRAKLALDNIVMLHTTERGGKAYQHALNELPESLETLMLVALLGAMTAGIFLFFMQGKGMGKLSMGLIAIAVASGLLWVAEIQPQWIAASIILEFFLMALLIPEPEKQRTPQDNQLIYVILTILTIIGLVAANEMGLIEKTKTDFGFYQVKTETTILDVDLRPASAWTLYAVATTILTPMLRHTIENTSANLSLAAIANQAAVLMGLGKGWPLHRMDLGVPLLAMGCYSQVNPTTLTASLVMLLVHYAIIGPGLQAKATREAQKRTAAGIMKNPTVDGITVIDLEPISYDPKFEKQLGQVMLLVLCAGQLLLMRTTWAFCEVLTLATGPILTLWEGNPGRFWNTTIAVSTANIFRGSYLAGAGLAFSLIKNTQTPRRGTGTTGETLGEKWKRQLNSLDRKEFEEYKRSGILEVDRTEAKSALKDGSKIKYAVSRGTSKIRWIVERGMVKPKGKVVDLGCGRGGWSYYMATLKNVTEVKGYTKGGPGHEEPIPMATYGWNLVKLHSGVDVFYKPTEQVDTLLCDIGESSSNPTIEEGRTLRVLKMVEPWLSSKPEFCIKVLNPYMPTVIEELEKLQRKHGGSLVRCPLSRNSTHEMYWVSGVSGNIVSSVNTTSKMLLNRFTTRYRKPTYEKDADLGAGTRSVSTETEKPDMAIIGRRLQRLQEEHKETWHYDQENPYRTWAYHGSYEAPSTGSASSMVNGVVKLLTKPWDVIPMVTQLAMTDTTPFGQQRVFKEKVDTRTPQPKPGTRMIMTTTANWLWALLGKKKNPRLCTREEFISKVRSNAAIGAVFQEEQGWTSASEAVNDSRFWELVDKERALHQEGKCESCVYNMMGKREKKLGEFGRAKGSRAIWYMWLGARFLEFEALGFLNEDHWFGRENSWSGVEGEGLHRLGYILEDIDKKDGDLIYADDTAGWDTRITEDDLLNEELITEQMAPHHKILAKAIFKLTYQNKVVKVLRPTPKGAVMDIISRKDQRGSGQVGTYGLNTFTNMEVQLIRQMEAEGVITRDDMHNPKGLKERVEKWLKECGVDRLKRMAISGDDCVVKPLDERFSTSLLFLNDMGKVRKDIPQWEPSKGWKNWQEVPFCSHHFHKIFMKDGRSLVVPCRNQDELIGRARISQGAGWSLRETACLGKAYAQMWSLMYFHRRDLRLASMAICSAVPTEWFPTSRTTWSIHAHHQWMTTEDMLKVWNRVWIEDNPNMTDKTPVHSWEDIPYLGKREDLWCGSLIGLSSRATWAKNIHTAITQVRNLIGKEEYVDYMPVMKRYSAPFESEGVL

SEQ ID NO: 5156 - protein, 3288 aa, Artificial Sequence
  derived and/or modified protein sequence (wt) from DENV-4__FJ024476__SS-prME
STITLLCLIPTVMAFHLSTRDGEPLMIVAKHERGRPLLFKTTEGINKCTLIAMDLGEMCEDTVTYKCPLLVNTEPEDIDCWCNLTATWVMYGTCTQSGERRREKRSVALTPHSGMGLETRAETWMSSEGAWKHAQRVESWILRNPGFALLAGFMAYMIGQTGIQRTVFFVLMMLVAPSYGMRCVGVGNRDFVEGVSGGAWVDLVLEHGGCVTTMAQGKPTLDFELTKTTAKEVALLRTYCIEASISNITTATRCPTQGEPYLKEEQDQQYICRRDVVDRGWGNGCGLFGKGGVVTCAKFSCSGKITGNLVQIENLEYTVVVTVHNGDTHAVGNDTSNHGVTAMITPRSPSVEVKLPDYGELTLDCEPRSGIDFNEMILMKMKKKTWLVHKQWFLDLPLPWTAGADTSEVHWNYKERMVTFKVPHAKRQDVTVLGSQEGAMHSALAGATEVDSGDGNHMFAGHLKCKVRMEKLRIKGMSYTMCSGKFSIDKEMAETQHGTTVVKVKYEGAGAPCKVPIEIRDVNKEKVVGRIISSTPLAENTNSVTNIELEPPFGDSYIVIGVGNSALTLHWFRKGSSIGKMFESTYRGAKRMAILGETAWDFGSVGGLFTSLGKAVHQVFGSVYTTMFGGVSWMIRILIGLLVLWIGTNSRNTSMAMTCIAVGGITLFLGFTVQADMGCVVSWSGKELKCGSGIFVVDNVHTWTEQYKFQPESPARLASAILNAHKDGVCGIRSTTRLENVMWKQITNELNYVLWEGGHDLTVVAGDVKGVLTKGKRALTPPVSDLKYSWKTWGKARIFTPEARNSTFLIDGPDTSECPNERRAWNSLEVEDYGFGMFTTNIWMKFREGSSEVCDHRLMSAAIKDQKAVHADMGYWIESSKNQTWQIERASLIEVKTCLWPKTHTLWSNGVLESQMLIPKSYAGPFSQHNYRQGYATQTMGPWHLGKLEIGFGECPGTTVTIQEDCDHRGPSLRTTTASGKLVTQWCCRSCTMPPLRFLGEDGCWYGMEIRPLSEREENMVKSQVTAGQGTSETFSMGLLCLTLFVEECLRRRVTRKHMILVVVITLCAIILGGLTWMDLLRALIMLGDTMSGRIGGQIHLAIMAVFKMSPGYVLGVFLRKLTSRETALMVIGMAMTTVLSIPHDLMELIDGISLGLILLKIVTQFDNTQVGTLALSLTFIRSTMPLVMAWRTIMAVLFVVTLIPLCRTSCLQKQSHWVEITALILGAQALPVYLMTLMKGASRRSWPLNEGIMAVGLVSLLGSALLKNDVPLAGPMVAGGLLLAAYVMSGSSADLSLEKAANVQWDEMADITGSSPIIEVKQDEDGSFSIRDVEETNMITLLVKLALITVSGLYPLAIPVTMTLWYMWQVKTQRSGALWDVPSPAATQKAALSEGVYRIMQRGLFGKTQVGVGIHMEGVFHTMWHVTRGSVICHETGRLEPSWADVRNDMISYGGGWRLGDKWDKEEDVQVLAIEPGKNPKHVQTKPGLFKTLTGEIGAVTLDFKPGTSGSPIINRKGKVIGLYGNGVVTKSGDYVSAITQAERIGEPDYEVDEDIFRKKRLTIMDLHPGAGKTKRILPSIVREALKRRLRTLILAPTRVVAAEMEEALRGLPIRYQTPAVKSEHTGREIVDLMCHATFTTRLLSSTRVPNYNLIVMDEAHFTDPSSVAARGYISTRVEMGEAAAIFMTATPPGATDPFPQSNSPIEDIEREIPERSWNTGFDWITDYQGKTVWFVPSIKAGNDIANCLRKSGKKVVQLSRKTFDTEYPKTKLTDWDFVVTTDISEMGANFRAGRVIDPRRCLKPVILTDGPERVILAGPIPVTPASAAQRRGRIGRNPAQEDDQYVFSGDPLKNDEDHAHWTEAKMLLDNIYTPEGIIPTLFGPEREKTQAIDGEFRLRGEQRKTFVELMRRGDLPVWLSYKVASAGISYKDREWCFTGERNNQILEENMEVEIWTREGEKKKLRPRWLDARVYADPMALKDFKEFASGRKSITLDILTEIASLPTYLSSRAKLALDNIVMLHTTERGGRAYQHALNELPESLETLMLVALLGAMTAGIFLFFMQGKGIGKLSMGLITIAVASGLLWVAEIQPQWIAASIILEFFLMVLLIPEPEKQRTPQDNQLIYVILTILTIIGLIAANEMGLIEKTKTDFGFYQVKTETTILDVDLRPASAWTLYAVATTILTPMLRHTIENTSANLSLAAIANQAAVLMGLGKGWPLHRMDLGVPLLAMGCYSQVNPTTLTASLVMLLVHYAIIGPGLQAKATREAQKRTAAGIMKNPTVDGITVIDLEPISYDPKFEKQLGQVMLLVLCAGQLLLMRTTWAFCEVLTLATGPILTLWEGNPGRFWNTTIAVSTANIFRGSYLAGAGLAFSLIKNAQTPRRGTGTTGETLGEKWKRQLNSLDRKEFEEYKRSGILEVDRTEAKSALKDGSKIKHAVSRGSSKIRWIVERGMVKPKGKVVDLGCGRGGWSYYMATLKNVTEVKGYTKGGPGHEEPIPMATYGWNLVKLHSGVDVFYKPTEQVDTLLCDIGESSSNPTIEEGRTLRVLKMVEPWLSSKPEFCIKVLNPYMPTVIEELEKLQRKHGGNLVRCPLSRNSTHEMYWVSGASGNIVSSVNTTSKMLLNRFTTRHRKPTYEKDVDLGAGTRSVSTETEKPDMTIIGRRLQRLQEEHKETWHYDQENPYRTWAYHGSYEAPSTGSASSMVNGVVKLLTKPWDVIPMVTQLAMTDTTPFGQQRVFKEKVDTRTPQPKPGTRMVMTTTANWLWALLGKKKNPRLCTREEFISKVRSNAAIGAVFQEEQGWTSASEAVNDSRFWELVDKERALHQEGKCESCVYNMMGKREKKLGEFGRAKGSRAIWYMWLGARFLEFEALGFLNEDHWFGRENSWSGVEGEGLHRLGYILEEIDKKDGDLMYADDTAGWDTRITEDDLQNEELITEQMAPHHKILAKAIFKLTYQNKVVKVLRPTPRGAVMDIISRKDQRGSGQVGTYGLNTFTNMEVQLIRQMEAEGVITQDDMQNPKGLRERVEKWLKECGVDRLKRMAISGDDCVVKPLDERFGTSLLFLNDMGKVRKDIPQWEPSKGWKNWQEVPFCSHHFHKIFMKDGRSLVVPCRNQDELIGRARISQGAGWSLRETACLGKAYAQMWSLMYFHRRDLRLASMAICSAVPTEWFPTSRTTWSIHAHHQWMTTEDMLKVWNRVWIEDNPNMTDKTPVHSWEDIPYLGKREDLWCGSLIGLSSRATWAKNIHTAITQVRNLIGKEEYVDYMPVMKRYSAPSESEGVL

SEQ ID NO: 5157 - protein, 3288 aa, Artificial Sequence
  derived and/or modified protein sequence (wt) from DENV-4__GQ868579__SS-prME
STITLLCLIPTIMAFHLSTRDGEPLMIVAKHERGRPLLFKTTEGINKCTLIAMDLGEMCEDTVTYKCPLLINTEPEDIDCWCNLTSTWVMYGTCTQSGERRREKRSVALTPHSGMGLETRAETWMSSEGAWKHAQRVESWILRNPGFALLAGFMAYMIGQTGIQRTVFFILMMLVAPSYGMRCVGVGNRDFVEGVSGGAWVDLVLEHGGCVTTMAQGKPTLDFELTKTTAKEVALLRTYCIEALISNITTATRCPTQGEPYLKEEQDQQYICRRDVVDRGWGNGCGLFGKGGVVTCAKFSCSGKITGNLVQIENLEYTVVVTVHNGDTHAVGNDTSNHGVTATITPRSPSVEVKLPDYGELTLDCEPRSGIDFNEMILMKMKKKTWLVHKQWFLDLPLPWTAGADTSEVHWNYKERMVTFKVPHAKRQDVTVLGSQEGAMHSALAGATEVDSGDGNHMFAGHLKCKVRMEKLRIKGMSYTMCSGKFSIDKEMAETQHGTTVVKVKYEGAGAPCKVPIEIRDVNKEKVVGRVISSTPLAENTNSVTNIELEPPFGDSYIVIGVGNSALTLHWFRKGSSIGKMFESTYRGAKRMAILGETAWDFGSVGGLFTSLGKAVHQVFGSVYTTMFGGVSWMIRILIGFLVLWIGTNSRNTSMAMTCIAVGGITLFLGFTVRADMGCVVSWSGRELKCGSGIFVVDNVHTWTEQYKFQPESPARLASAILNAHKDGVCGIRSTTRLENVMWKQITNELNYVLWEGGHDLTVVAGDVKGVLTKGKRALTPPVSDLKYSWKTWGKAKIFTPEARNSTFLIDGPDTSECPNERRAWNSLEVEDYGFGMFTTNIWMKFREGSSEVCDHRLMSAAIKDQKAVHADMGYWIESSKNQTWQIERASLIEVKTCLWPKTHTLWSNGVLESQMLIPKSYAGPFSQHNYRQGYATQTVGPWHLGKLEIDFGECPGTTVTIQEDCDHRGPSLRTTTASGKLVTQWCCRSCTMPPLRFLGEDGCWYGMEIRPLSEKEENMVKSQVTAGQSTSETFSMGLLCLTLFVEECLRRRVTRKHMILAVVITLCAIILGGLTWMDLLRALIMLGDTMSGRIGGQTHLAIMAVFKMSPGYVLGVFLRKLTSRETALMVIGMAMTTTLSIPHDLMELIDGISLGLILLKIVTQFDNTQVGTLALSLTFIRSTMSLVMAWRTIMAVLFVVTLIPLCRTSCLQKQSHWVEITALILGAQALPVYLMTLMKGASRRSWPLNEGIMAVGLVSLLGSALLKNDVPLAGPMVAGGLLLAAYVMSGSSADLSLEKAANVQWDEMADITGSSPIIEVKQDEDGSFSIRDVEETNMITLLVKLALITVSGLYPLAIPVTMTLWYMWQVKTQRSGALWDVPSPAATQKAALSEGVYRIMQRGLFGKTQVGVGIHMEGVFHTMWHVTRGSVICHETGRLEPSWADVRNDMISYGGGWRLGDKWDREEDVQVLAIEPGKNPKHVQTKPGLFKTLTGEIGAVTLDFKPGTSGSPIINKKGKVIGLYGNGVVTKSGDYVSAITQAERIGEPDYEVDEDIFRKKRLTIMDLHPGAGKTKRILPSIVREALKRRLRTLILAPTRVVAAEMEEALRGLPIRYQTPAVKSEHTGREIVDLMCHATFTTRLLSSTRVPNYNLIVMDEAHFTDPSSVAARGYISTRVEMGEAAAIFMTATPPGATDPFPQSNSPIEDIEREIPERSWNTGFDWITDYQGKTVWFVPSIKAGNDIANCLRKSGKKVIQLSRKTFDTEYPKTKLTDWDFVVTTDISEMGANFRAGRVIDPRRCLKPVILTDGPERVILAGPIPVTPASAAQRRGRIGRNPAQEDDQYVFSGDPLKNDEDHAHWTEAKMLLDNIYTPEGIIPTLFGPEREKTQAIDGEFRLRGEQRKTFVELMRRGDLPVWLSYKVASAGISYKDREWCFTGERNNQILEENMEVEIWTREGEKKKLRPRWLDARVYADPMALKDFKEFASGRKSITLDILTEIASLPTYLSSRAKLALDNIVMLHTTERGGRAYQHALNELPESLETLMLVALLGAMTAGTFLFFMQGKGIGKLSMGLITIAMASGLLWIAEIQPQWIAASIILEFFLMVLLIPEPEKQRTPQDNQLIYVILTILAIIGLIAANEMGLIEKTKTDFGFYQVKTETTILDVDLRPASAWTLYAVATTILTPMLRHTIENTSANLSLAAIANQAAVLMGLGKGWPLHRMDLGVPLLAMGCYSQVNPTTLTASLVMLLVHYAIIGPGLQAKATREAQKRTAAGIMKNPTVDGITVIDLEPISYDPKFEKQLGQVMLLVLCAGQLLLMRTTWAFCEVLTLATGPILTLWEGNPGRFWNTTIAVSTANIFRGSYLAGAGLAFSLIKNAQAPRRGTGTTGETLGEKWKRQLNSLDRKEFEEYKRSGILEVDRTEAKSALKDGSKIKHAVSRGSSKIRWIVERGMVKPKGKVVDLGCGRGGWSYYMATLKNVTEVKGYTKGGPGHEEPIPMATYGWNLVKLHSGVDVFYKPTEQVDTLLCDIGESSSNPTIEEGRTLRVLKMVEPWLSSKPEFCIKVLNPYMPTVIEELEKLQRKHGGNLVRCPLSRNSTHEMYWVSGASGNIVSSVNTTSKMLLNRFTTRHRKPTYEKDVDLGAGTRSVSTETEKPDMTIIGRRLQRLQEEHKETWHYDQENPYRTWAYHGSYEAPSTGSASSMVNGVVKLLTKPWDVIPMVTQLAMTDTTPFGQQRVFKEKVDTRTPQPKPGTRMVMTTTANWLWALLGKKKSPRLCTREEFISKVRSNAAIGAVFQEEQGWTSASEAVNDSRFWELVDKERALHQEGKCESCVYNMMGKREKKLGEFGRAKGSRAIWYMWLGARFLEFEALGFLNEDHWFGRENSWSGVEGEGLHRLGYILEEIDKKDGDLMYADDTAGWDTRITEDDLQNEELITEQMAPHHKILAKAIFKLTYQNKVVKVLRPTPRGAVMDIISRKDQRGSGQVGTYGLNTFTNMEVQLIRQMEAEGVITQDDMQNPKGLKERVENWLRECGVDRLKRMAISGDDCVVKPLDERFGTSLLFLNDMGKVRKDIPQWEPSKGWKNWQEVPFCSHHFHKIFMKDGRSLVVPCRNQDELIGRARISQGAGWSLRETACLGKAYAQMWSLMYFHRRDLRLASMAICSAVPTEWFPTSRTTWSIHAHHQWMTTEDMLKVWNRVWIEDNPNMIDKTPVHSWEDIPYLGKREDLWCGSLIGLSSRATWAKNIHTAITQVRNLIGKEEYVDYMPVMKRYSAPSESEGVL

SEQ ID NO: 5158 - protein, 3288 aa, Artificial Sequence
  derived and/or modified protein sequence (wt) from DENV-4__GQ868580__SS-prME
STITLLCLIPTIMAFHLSTRDGEPLMIVAKHERGRPLLFKTTEGINKCTLIAMDLGEMCEDTVTYKCPLLINTEPEDIDCWCNLTSTWVMYGTCTQSGERRREKRSVALTPHSGMGLETRAETWMSSEGAWKHAQRVESWILRNPGFALLAGFMAYMIGQTGIQRTVFFVLMMLVAPSYGMRCVGVGNRDFVEGVSGGAWVDLVLEHGGCVTTMAQGKPTLDFELTKTTAKEVALLRTYCIEALISNITTATRCPTQGEPYLKEEQDQQYICRRDVVDRGWGNGCGLFGKGGVVTCAKFSCSGKITGNLVQIENLEYTVVVTVHNGDTHAVGNDTSNHGVTATITPRSPSVEVKLPDYGELTLDCEPRSGIDFNEMILMKMKKKTWLVHKQWFLDLPLPWTAGADTSEVHWNYKERMVTFKVPHAKRQDVTVLGSQEGAMHSALAGATEVDSGDGNHMFAGHLKCKVRMEKLRIKGMSYTMCSGKFSIDKEMAETQHGTTVVKVKYEGAGAPCKVPIEIRDVNKEKVVGRIISSTPLAENTNSVTNIELEPPFGDSYIVIGVGNSALTLHWFRKGSSIGKMFESTYRGAKRMAILGETAWDFGSVGGLFTSLGKAVHQVFGSVYTTMFGGVSWMIRILIGFLVLWIGTNSRNTSMAMTCIAVGGITLFLGFTVQADMGCVVSWSGRELKCGSGIFVVDNVHTWTEQYKFQPESPARLASAILNAHKDGVCGIRSTTRLENVMWKQITNELNYVLWEGGHDLTVVAGDVKGVLTKGKRALTPPVSDLKYSWKTWGKAKIFTPEARNSTFLIDGPDTSECPNERRAWNSLEVEDYGFGMFTTNIWMKFREGSSEVCDHRLMSAAIKDQKAVHADMGYWIESSKNQTWQIERASLIEVKTCLWPKTHTLWSNGVLESQMLIPKSYAGPFSQHNYRQGYATQTVGPWHLGKLEIDFGECPGTTVTIQEDCDHRGPSLRTTTASGKLVTQWCCRSCTMPPLRFLGEDGCWYGMEIRPLNEKEENMVKSQVTAGQSTSETFSMGLLCLTLFVEECLRRRVTRKHMILAVVITLCAIILGGLTWMDLLRALIMLGDTMSGRIGGQTHLAIMAVFKMSPGYVLGVFLRKLTSRETALMVIGMAMTTTFSIPHDLMELIDGISLGLILLKIVTQFDNTQVGTLALSLTFIRSTMSLVMAWRTIMAVLFVVTLIPLCRTSCLQKQSHWVEITALILGAQALPVYLMTLMKGASRRSWPLNEGIMAVGLVSLLGSALLKNDVPLAGPMVAGGLLLAAYVMSGSSADLSLEKAANVQWDEMADITGSSPIIEVKQDEDGSFSIRDVEETNMITLLVKLALITVSGLYPLAIPVTMTLWYMWQVKTQRSGALWDVPSPAATQKAALSEGVYRIMQRGLLGKTQVGVGIHMEGVFHTMWHVTRGSVICHETGRLEPSWADVRNDMISYGGGWRLGDKWDREEDVQVLAIEPGKNPKHVQTKPGLFKTLTGEIGAVTLDFKPGTSGSPIINRKGKVIGLYGNGVVTKSGDYVSAITQAERIGEPDYEVDEDIFRKKRLTIMDLHPGAGKTKRILPSIVREALKRRLRTLILAPTRVVAAEMEEALRGLPIRYQTPAVKSEHTGREIVDLMCHATFTTRLLSSTRVPNYNLIVMDEAHFTDPSSVAARGYISTRVEMGEAAAIFMTATPPGATDPFPQSNSPIEDIEREIPERSWNTGFDWITDYQGKTVWFVPSIKAGNDIANCLRKSGKKVIQLSRKTFDTEYPKTKLTDWDFVVTTDISEMGANFRAGRVIDPRRCLKPVILTDGPERVILAGPIPVTPASAAQRRGRIGRNPAQEDDQYVFSGDPLKNDEDHAHWTEAKMLLDNIYTPEGIIPTLFGPEREKTQAIDGEFRLRGEQRKTFVELMRRGDLPVWLSYKVASAGISYKDREWCFTGERNNQILEENMEVEIWTREGEKKKLRPRWLDARVYADPMALKDFKEFASGRKSITLDILTEIASLPTYLSSRAKLALDNIVMLHTTERGGRAYQHALNELPESLETLMLVALLGAMTAGIFLFFMQGKGIGKLSMGLITIAMASGLLWIAEIQPQWIAASIILEFFLMVLLIPEPEKQRTPQDNQLIYVILTILTIIGLIAANEMGLIEKTKTDFGFYQVKTETTILDVDLRPASAWTLYAVATTILTPMLRHTIENTSANLSLAAIANQAAVLMGLGKGWPLHRMDLGVPLLAMGCYSQVNPTTLTASLVMLLVHYAIIGPGLQAKATREAQKRTAAGIMKNPTVDGITVIDLEPISYDPKFEKQLGQVMLLVLCAGQLLLMRTTWAFCEVLTLATGPILTLWEGNPGRFWNTTIAVSTANIFRGSYLAGAGLAFSLIKNAQTPRRGTGTTGETLGEKWKRQLNSLDRKEFEEYKRSGILEVDRTEAKSALKDGSKIKHAVSRGSSKIRWIVERGMVKPKGKVVDLGCGRGGWSYYMATLKNVTEVKGYTKGGPGHEEPIPMATYGWNLVKLHSGVDVFYKPTEQVDTLLCDIGESSSNPTIEEGRTLRVLKMVEPWLSSKPEFCIKVLNPYMPTVIEELEKLQRKHGGNLVRCPLSRNSTHEMYWVSGASGNIVSSVNTTSKMLLNRFTTRHRKPTYEKDVDLGAGTRSVSTETEKPDMTIIGRRLQRLQEEHKETWHYDQENPYRTWAYHGSYEAPSTGSASSMVNGVVKLLTKPWDVIPMVTQLAMTDTTPFGQQRVFKEKVDTRTPQPKPGTRMVMTTTANWLWALLGKKKSPRLCTREEFISKVRSNAAIGAVFQEEQGWTSASEAVSDSRFWELVDKERALHQEGKCESCVYNMMGKREKKLGEFGRAKGSRAIWYMWLGARFLEFEALGFLNEDHWFGRENSWSGVEGEGLHRLGYILEEIDKKDGDLMYADDTAGWDTRITEDDLQNEELITEQMAPHHKILAKAIFKLTYQNKVVKVLRPTPRGAVMDIISRKDQRGSGQVGTYSLNTFTNMEVQLIRQMEAEGVITQDDMQNPKGLKERVENWLRECGVDRLKRMAISGDDCVVKPLDERFGTSLLFLNDMGKVRKDIPQWEPSKGWKNWQEVPFCSHHFHKIFMKDGRSLVVPCRNQDELIGRARISQGAGWSLRETACLGKAYAQMWSLMYFHRRDLRLASMAICSAVPTEWFPTSRTTWSIHAHHQWMTTEDMLKVWNRVWIEDNPNMIDKTPVHSWEDIPYLGKREDLWCGSLIGLSSRATWAKNIHTAITQVRNLIGKEEYVDYMPVMKRYSAPSESEGVL

SEQ ID NO: 5159 - protein, 3288 aa, Artificial Sequence
  derived and/or modified protein sequence (wt) from DENV-4__GQ868583__SS-prME
STITLLCLIPTVMAFHLSTRDGEPLMIVAKHERGRPLLFKTTEGINKCTLIAMDLGEMCEDTVTYKCPLLVNTEPEDIDCWCNLTSTWVMYGTCTQSGERRREKRSVALTPHSGMGLETRAETWMSSEGAWKHAQRVESWILRNPGFALLAGFMAYMIGQTGIQRTVFFVLMMLVAPSYGMRCVGVGNRDFVEGVSGGAWVDLVLEHGGCVTTMAQGKPTLDFELTKTTAKEVALLRTYCIEALISNITTATRCPTQGEPYLKEEQDQQYICRRDVVDRGWGNGCGLFGKGGVVTCAKFSCSGKITGNLVQIENLEYTVVVTVHNGDTHAVGNDTSNHGVTATITPRSPSVEVKLPDYGELTLDCEPRSGIDFNEMILMKMKKKTWLVHKQWFLDLPLPWTTGADTSEVHWNYKERMVTFKVPHAKRQDVTVLGSQEGAMHSALAGATEVDSGDGNHMFAGHLKCKVRMEKLRIKGMSYTMCSGKFSIDKEMAETQHGTTVVKVKYEGAGAPCKVPIEIRDVNKEKVVGRVISATPLAENTNSVTNIELEPPFGDSYIMIGVGNSALTLHWFRKGSSIGKMFESTYRGAKRMAILGETAWDFGSVGGLFTSLGKAVHQVFGSVYTTMFGGVSWMIRILIGFLVLWIGTNSRNTSMAMTCIAVGGITLFLGFTVQADMGCVVSWSGRELKCGSGIFVVDNVHTWTEQYKFQPESPARLASAILNAHKDGVCGIRSTTRLENVMWKQITNELNYVLWEGGHDLTVVAGDVKGVLTKGKRALAPPASDLKYSWKTWGKAKIFTPEARNSTFLIDGPDTSECPNERRAWNSFEVEDYGFGMFTTNIWMKFREGSSEVCDHRLMSAAIKDQKAVHADMGYWIESSKNQTWQIERASLIEVKTCLWPKTHTLWSNGVLESQMLIPKSYAGPFSQHNYRQGYATQTVGPWHLGKLEIDFGECPGTTVTIQEDCDHRGPSLRTTTASGKLVTQWCCRSCTMPPLRFLGEDGCWYGMEIRPLSEKEENMVKSQVTAGQGTSETFSMGLLCLTLFVEECLRRRVTRKHMILAVVITLCAIILGGLTWMDLLRALIMLGDTMSGRIGGQTHLAIMAVFKMSPGYVLGVFLRKLTSRETALMVIGMAMTTTLSIPHDLMELIDGISLGLILLKIVTQFDNTQVGTLALSLTFIRSTMSLVMAWRTIMAVLFVVTLIPLCRTSCLQKQSHWVEITALILGAQALPVYLMTLMKGASRRSWPLNEGIMAVGLVSLLGSALLKNDVPLAGPMVAGGLLLAAYVMSGSSADLSLEKAANVQWDEMADITGSSPIIEVKQDEDGSFSIRDVEETNMITLLVKLALITVSGLYPLAIPVTMTLWYMWQVKTQRSGALWDVPSPAATQKAALSEGVYRIMQRGLFGKTQVGVGIHMEGVFHTMWHVTRGSVICHETGRLEPSWADVRNDMISYGGGWRLGDKWDKEEDVQVLAIEPGKNPKHVQTKPGLFKTLTGEIGAVTLDFKPGTSGSPIINRKGKVIGLYGNGVVTKSGDYVSAITQAERIGEPDYEVDEDIFRKKRLTIMDLHPGAGKTKRILPSIVREALKRRLRTLILAPTRVVAAEMEEALRGLPIRYQTPAVKSEHTGREIVDLMCHATFTTRLLSSTRVPNYNLIVMDEAHFTDPSSVAARGYISTRVEMGEAAAIFMTATPPGATDPFPQSNSPIEDIEREIPERSWNTGFDWITDYQGKTVWFVPSIKAGNDIANCLRKSGKKVIQLSRKTFDTEYPKTKLTDWDFVVTTDISEMGANFRAGRVIDPRRCLKPVILTDGPERVILAGPIPVTPASAAQRRGRIGRNPAQEDDQYVFSGDPLKNDEDHAHWTEAKMLLDNIYTPEGIIPTLFGPEREKTQAIDGEFRLRGEQRKTFVELMRRGDLPVWLSYKVASAGISYKDREWCFTGERNNQILEENMEVEIWTREGEKKKLRPKWLDARVYADPMALQDFKEFASGRKSITLDILTEIASLPTYLSSRAKLALDNIVMLHTTERGGRAYQHALNELPESLETLMLVALLGAMTAGIFLFFMQGKGIGKLSMGLITIAVASGLLWVAEIQPQWIAASIILEFFLMVLLIPEPEKQRTPQDNQLIYVILTILTIIGLIAANEMGLIEKTKTDFGFYQVKTETTILDVDLRPASAWTLYAVATTILTPMLRHTIENTSANLSLAAIANQAAVLMGLGKGWPLHRMDLGVPLLAMGCYSQVNPTTLTASLVMLLVHYAIIGPGLQAKATREAQKRTAAGIMKNPTVDGITVIDLEPISYDPKFEKQLGQVMLLVLCAGQLLLMRTTWAFCEVLTLATGPILTLWEGNPGRFWNTTIAVSTANIFRGSYLAGAGLAFSLIKNAQTPRRGTGTTGETLGEKWKRQLNSLDRKEFEEYKRSGILEVDRTEAKSALKDGSKIKHAVSRGSSKIRWIVERGMVKPKGKVVDLGCGRGGWSYYMATLKNVTEVKGYTKGGPGHEEPIPMATYGWNLVKLHSGVDVFYKPTEQVDTLLCDIGESSSNPTIEEGRTLRVLKMVEPWLSSKPEFCIKVLNPYMPTVIEELEKLQRKHGGNLVRCPLSRNSTHEMYWVSGASGNIVSSVNTTSKMLLNRFTTRHRKPTYEKDVDLGAGTRSVSTETEKPDMTIIGRRLQRLQEEHKETWHYDQENPYRTWAYHGSYEAPSTGSASSMVNGVVKLLTKPWDVIPMVTQLAMTDTTPFGQQRVFKEKVDTRTPQPKPGTRMVMTTTANWLWALLGKKKNPRLCTREEFISKVRSNAAIGAVFQEEQGWTSASEAVSDSRFWELVDKERALHQEGKCESCVYNMMGKREKKLGEFGRAKGSRAIWYMWLGARFLEFEALGFLNEDHWFGRENSWSGVEGEGLHRLGYILEEIDKKDGDLMYADDTAGWDTRITEDDLQNEELITEQMAPHHKILAKAIFKLTYQNKVVKVLRPTPRGAVMDIISRKDQRGSGQVGTYGLNTFTNMEVQLIRQMEAEGVITQDDMQNPKGLKERVEKWLRECGVDRLKRMAISGDDCVVKPLDERFGTSLLFLNDMGKVRKDIPQWEPSKGWKNWQEVPFCSHHFHKIFMKDGRSLVVPCRNQDELIGRARISQGAGWSLRETACLGKAYAQMWSLMYFHRRDLRLASMAICSAVPTEWFPTSRTTWSIHAHHQWMTTEDMLKVWNRVWIEDNPNMIDKTPVHSWEDIPYLGKREDLWCGSLIGLSSRATWAKNIHTAITQVRNLIGKEEYVDYMPVMKRYSAPSESEGVL

SEQ ID NO: 5160 - protein, 3288 aa, Artificial Sequence
  derived and/or modified protein sequence (wt) from DENV-4__GQ868584__SS-prME
STITLLCLIPTVMAFHLSTRDGEPLMIVAKHERGRPLLFKTTEGINKCTLIAMDLGEMCEDTVTYKCPLLVNTEPEDIDCWCNLTSTWVMYGTCTQSGERRREKRSVALTPHSGMGLETRAETWMSSEGAWKHAQRVESWILRNPGFALLAGFMAYMIGQTGIQRTVFFVLMMLVAPSYGMRCVGVGNRDFVEGVSGGAWVDLVLEHGGCVTTMAQGKPTLDFELTKTTAKEVALLRTYCIEALISNITTATRCPTQGEPYLKEEQDRQYICRRDVVDRGWGNGCGLFGKGGVVTCAKFSCSGKITGNLVQIENLEYTVVVTVHNGDTHAVGNDTSNHGVTATITPRSPSVEVKLPDYGELTLDCEPRSGIDFNEMILMKMKKKTWLVHKQWFLDLPLPWTTGADTSEVHWNYKERMVTFKVPHAKRQDVTVLGSQEGAMHSALAGATEVDSGDGNHMFAGHLKCKVRMEKLRIKGMSYTMCSGKFSIDKEMAETQHGTTVVKVKYEGAGAPCKVPIEIRDVNKEKVVGRVISATPLAENTNSVTNIELEPPFGDSYIMIGVGNSALTLHWFRKGSSIGKMFESTYRGAKRMAILGETAWDFGSVGGLFTSLGKAVHQVFGSVYTTMFGGVSWMIRILIGFLVLWIGTNSRNTSMAMTCIAVGGITLFLGFTVQADMGCVVSWSGRELKCGSGIFVVDNVHTWTEQYKFQPESPARLASAILNAHKDGVCGIRSTTRLENVMWKQITNELNYVLWEGGHDLTVVAGDVKGVLTKGKRALAPPASDLKYSWKTWGKAKIFTPEARNSTFLIDGPDTSECPNERRAWNSFEVEDYGFGMFTTNIWMKFREGSSEVCDHRLMSAAIKDQKAVHADMGYWIESSKNQTWQIERASLIEVKTCLWPKTHTLWSNGVLESQMLIPKSYAGPFSQHNYRQGYATQTVGPWHLGKLEIDFGECPGTTVTIQEDCDHRGPSLRTTTASGKLVTQWCCRSCTMPPLRFLGEDGCWYGMEIRPLSEKEENMVKSQVTAGQGTSETFSMGLLCLTLFVEECLRRRVTRKHMILAVVITLCAIILGGLTWMDLLRALIMLGDTMSGRIGGQTHLAIMAVFKMSPGYVLGVFLRKLTSRETALMVIGMAMTTTLSIPHDLMELIDGISLGLILLKIVTQFDNTQVGTLALSLTFIRSTMSLVMAWRTIMAVLFVVTLIPLCRTSCLQKQSHWVEITALILGAQALPVYLMTLMKGASRRSWPLNEGIMAVGLVSLLGSALLKNDVPLAGPMVAGGLLLAAYVMSGSSADLSLEKAANVQWDEMADITGSSPIIEVKQDEDGSFSIRDVEETNMITLLVKLALITVSGLYPLAIPVTMTLWYMWQVKTQRSGALWDVPSPAATQKAALSEGVYRIMQRGLFGKTQVGVGIHMEGVFHTMWHVTRGSVICHETGRLEPSWADVRNDMISYGGGWRLGDKWDKEEDVQVLAIEPGKNPKHVQTKPGLFKTLTGEIGAVTLDFKPGTSGSPIINRKGKVIGLYGNGVVTKSGDYVSAITQAERIGEPDYEVDEDIFRKKRLTIMDLHPGAGKTKRILPSIVREALKRRLRTLILAPTRVVAAEMEEALRGLPIRYQTPAVKSEHTGREIVDLMCHATFTTRLLSSTRVPNYNLIVMDEAHFTDPSSVAARGYISTRVEMGEAAAIFMTATPPGATDPFPQSNSPIEDIEREIPERSWNTGFDWITDYQGKTVWFVPSIKAGNDIANCLRKSGKKVIQLSRKTFDTEYPKTKLTDWDFVVTTDISEMGANFRAGRVIDPRRCLKPVILTDGPERVILAGPIPVTPASAAQRRGRIGRNPAQEDDQYVFSGDPLKNDEDHAHWTEAKMLLDNIYTPEGIIPTLFGPEREKTQAIDGEFRLRGEQRKTFVELMRRGDLPVWLSYKVASAGISYKDREWCFTGERNNQILEENMEVEIWTREGEKKKLRPKWLDARVYADPMALKDFKEFASGRKSITLDILTEIASLPTYLSSRAKLALDNIVMLHTTERGGRAYQHALNELPESLETLMLVALLGAMTAGIFLFFMQGKGIGKLSMGLITIAVASGLLWVAEIQPQWIAASIILEFFLMVLLIPEPEKQRTPQDNQLIYVILTILTIIGLIAANEMGLIEKTKTDFGFYQVKTETTILDVDLRPASAWTLYAVATTILTPMLRHTIENTSANLSLAAIANQAAVLMGLGKGWPLHRMDLGVPLLAMGCYSQVNPTTLTASLVMLLVHYAIIGPGLQAKATREAQKRTAAGIMKNPTVDGITVIDLEPISYDPKFEKQLGQVMLLVLCAGQLLLMRTTWAFCEVLTLATGPILTLWEGNPGRFWNTTIAVSTANIFRGSYLAGAGLAFSLIKNAQTPRRGTGTTGETLGEKWKRQLNSLDRKEFEEYKRSGILEVDRTEAKSALKDGSKIKHAVSRGSSKIRWIVERGMVKPKGKVVDLGCGRGGWSYYMATLKNVTEVKGYTKGGPGHEEPIPMATYGWNLVKLHSGVDVFYKPTEQVDTLLCDIGESSSNPTIEEGRTLRVLKMVEPWLSSKPEFCIKVLNPYMPTVIEELEKLQRKHGGNLVRCPLSRNSTHEMYWVSGASGNIVSSVNTTSKMLLNRFTTRHRKPTYEKDVDLGAGTRSVSTETEKPDMTIIGRRLQRLQEEHKETWHYDQENPYRTWAYHGSYEAPSTGSASSMVNGVVKLLTKPWDVIPMVTQLAMTDTTPFGQQRVFKEKVDTRTPQPKPGTRMVMTTTANWLWALLGKKKNPRLCTREEFISKVRSNAAIGAVFQEEQGWTSASEAVSDSRFWELVDKERALHQEGKCESCVYNMMGKREKKLGEFGRAKGSRAIWYMWLGARFLEFEALGFLNEDHWFGRENSWSGVEGEGLHRLGYILEEIDKKDGDLMYADDTAGWDTRITEDDLQNEELITEQMAPHHKILAKAIFKLTYQNKVVKVLRPTPRGAVMDIISRKDQRGSGQVGTYGLNTFTNMEVQLIRQMEAEGVITQDDMQNPKGLKERVEKWLRECGVDRLKRMAISGDDCVVKPLDERFGTSLLFLNDMGKVRKDIPQWEPSKGWKNWQEVPFCSHHFHKIFMKDGRSLVVPCRNQDELIGRARISQGAGWSLRETACLGKAYAQMWSLMYFHRRDLRLASMAICSAVPTEWFPTSRTTWSIHAHHQWMTTEDMLKVWNRVWIEDNPNMIDKTPVHSWEDIPYLGKREDLWCGSLIGLSSRATWAKNIHTAITQVRNLIGKEEYVDYMPVMKRYSAPSESEGVL

SEQ ID NO: 5161 - protein, 3288 aa, Artificial Sequence
  derived and/or modified protein sequence (wt) from DENV-4__GQ868585__SS-prME
STITLLCLIPTVMAFHLSTRDGEPLMIVAKHERGRPLLFKTTEGINKCTLIAMDLGEMCEDTVTYKCPLLVNTEPEDIDCWCNLTSTWVMYGTCTQSGERRREKRSVALTPHSGMGLETRAETWMSSEGAWKHAQRVESWILRNPGFALLAGFMAYMIGQTGIQRTVFFVLMMLVAPSYGMRCVGVGNRDFVEGVSGGAWVDLVLEHGGCVTTMAQGKPTLDFELTKTTAKEVALLRTYCIEALISNITTATRCPTQGEPYLKEEQDQQYICRRDVVDRGWGNGCGLFGKGGVVTCAKFSCSGKITGNLVQIENLEYTVVVTVHNGDTHAVGNDTSNHGVTATITPRSPSVEVKLPDYGELTLDCEPRSGIDFNEMILMKMKKKTWLVHKQWFLDLPLPWTTGADTSEVHWNYKERMVTFKVPHAKRQDVTVLGSQEGAMHSALAGATEVDSGDENHMFAGHLKCKVRMEKLRIKGMSYTMCSGKFSIDKEMAETQHGTTVVKVKYEGAGAPCKVPIEIRDVNKEKVVGRVISATPLAENTNSVTNIELEPPFGDSYIVIGVGNSALTLHWFRKGSSIGKMFESTYRGAKRMAILGETAWDFGSVGGLFTSLGKAVHQVFGSVYTTMFGGVSWMIRILIGFLVLWIGTNSRNTSMAMTCIAVGGITLFLGFTVQADMGCVVSWSGRELKCGSGIFVVDNVHTWTEQYKFQPESPARLASAILNAHKDGVCGIRSTTRLENVMWKQITNELNYVLWEGGHDLTVVAGDVKGVLTKGKRALTPPASDLKYSWKTWGKAKIFTPEARNSTFLIDGPDTSECPNERRAWNSFEVEDYGFGMFTTNIWMKFREGSSEVCDHRLMSAAIKDQKAVHADMGYWIESSKNQTWQIERASLIEVKTCLWPKTHTLWSNGVLESQMLIPKSYAGPFSQHNYRQGYATQTVGPWHLGKLEIDFGECPGTTVTIQENCDHRGPSLRTTTASGKLVTQWCCRSCTMPPLRFLGEDGCWYGMEIRPLSEKEENMVKSQVTAGQGTSETFSMGLLCLTLFVEECLRRRVTRKHMILAVVITLCAIILGGLTWMDLLRALIMLGDTMSGRIGGQTHLAIMAVFKMSPGYVLGVFLRKLTSRETALMVIGMAMTTTLSIPHDLMELIDGISLGLILLKIVTQFDNTQVGTLALSLTFIRSTMSLVMAWRTIMAVLFVVTLIPLCRTSCLQKQSHWVEITALILGAQALPVYLMTLMKGASRRSWPLNEGIMAVGLVSLLGSALLKNDVPLAGPMVAGGLLLAAYVMSGSSADLSLEKAANVQWDEMADITGSSPIIEVKQDEDGSFSIRDVEETNMITLLVKLALITVSGLYPLAIPITMTLWYMWQVKTQRSGALWDVPSPAATQKAALSEGVYRIMQRGLFGKTQVGVGIHMEGVFHTMWHVTRGSVICHETGRLEPSWADVRNDMISYGGGWRLGDKWDKEEDVQVLAIEPGKNPKHVQTKPGLFKTLTGEIGAVTLDFKPGTSGSPIINRKGKVIGLYGNGVVTKSGDYVSAITQAERIGEPDYEVDEDIFRKKRLTIMDLHPGAGKTKRILPSIVREALKRRLRTLILAPTRVVAAEMEEALRGLPIRYQTPAVKSEHTGREIVDLMCHATFTTRLLSSTRVPNYNLIVMDEAHFTDPSSVAARGYISTRVEMGEAAAIFMTATPPGATDPFPQSNSPIEDIEREIPERSWNTGFDWITDYQGKTVWFVPSIKAGNDIANCLRKSGKKVIQLSRKTFDTEYPKTKLTDWDFVVTTDISEMGANFRAGRVIDPRRCLKPVILTDGPERVILAGPIPVTPASAAQRRGRIGRNPAQEDDQYVFSGDPLKNDEDHAHWTEAKMLLDNIYTPEGIIPTLFGPEREKTQAIDGEFRLRGEQRKTFVELMRRGDLPVWLSYKVASAGISYKDREWCFTGERNNQILEENMEVEIWTREGEKKKLRPKWLDARVYADPMALKDFKEFASGRKSITLDILTEIASLPTYLSSRAKLALDNIVMLHTTERGGRAYQHALNELPESLETLMLVALLGAMTAGIFLFFMQGKGIGKLSMGLITIAVASGLLWVAEIQPQWIAASIILEFFLMVLLIPEPEKQRTPQDNQLIYVILTILTIIGLIAANEMGLIEKTKTDFGFYQVKTETTILDVDLRPASAWTLYAVATTILTPMLRHTIENTSANLSLAAIANQAAVLMGLGKGWPLHRMDLGVPLLAMGCYSQVNPTTLTASLVMLLVHYAIIGPGLQAKATREAQKRTAAGIMKNPTVDGITVIDLEPISYDPKFEKQLGQVMLLVLCAGQLLLMRTTWAFCEVLTLATGPILTLWEGNPGRFWNTTIAVSTANIFRGSYLAGAGLAFSLIKNAQTPRRGTGTTGETLGEKWKRQLNSLDRKEFEEYKRSGILEVDRTEAKSALKDGSKIKHAVSRGSSKIRWIVERGMVKPKGKVIDLGCGRGGWSYYMATLKNVTEVKGYTKGGPGHEEPIPMATYGWNLVKLHSGVDVFYKPTEQVDTLLCDIGESSSNPTIEEGRTLRVLKMVEPWLSSKPEFCIKVLNPYMPTVIEELEKLQRKHGGNLVRCPLSRNSTHEMYWVSGASGNIVSSVNTTSKMLLNRFTTRHRKPTYEKDVDLGAGTRSVSTETEKPDMTIIGRRLQRLQEEHKETWHYDQENPYRTWAYHGSYEAPSTGSASSMVNGVVKLLTKPWDVIPMVTQLAMTDTTPFGQQRVFKEKVDTRTPQPKPGTRMVMTTTANWLWALLGKKKNPRLCTREEFISKVRSNAAIGAVFQEEQGWTSASEAVNDSRFWELVDKERALHQEGKCESCVYNMMGKREKKLGEFGRAKGSRAIWYMWLGARFLEFEALGFLNEDHWFGRENSWSGVEGEGLHRLGYILEEIDKKDGDLMYADDTAGWDTRITEDDLQNEELITEQMAPHHKILAKAIFKLTYQNKVVKVLRPTPRGAVMDIISRKDQRGSGQVGTYGLNTFTNMEVQLIRQMEAEGVITQDDMQNPKGLKERVEKWLRECGVDRLKRMAISGDDCVVKPLDERFGTSLLFLNDMGKVRKDIPQWEPSKGWKNWQEVPFCSHHFHKIFMKDGRSLVVPCRNQDELIGRARISQGAGWSLRETACLGKAYAQMWSLMYFHRRDLRLASMAICSAVPTEWFPTSRTTWSIHAHHQWMTTEDMLKVWNRVWIEDNPNMIDKTPVHSWEDIPYLGKREDLWCGSLIGLSSRATWAKNIHTAITQVRNLIGKEEYVDYMPVMKRYSAPSESEGVL

SEQ ID NO: 5162 - protein, 3288 aa, Artificial Sequence
  derived and/or modified protein sequence (wt) from DENV-4__JQ922560__SS-prME
STITLLCLIPTVMAFHLSTRDGEPLMIVAKHERGRRLLFKTTEGINKCTLIAMDLGEMCEDTVTYKCPLLVNTEPEDIDCWCNLTSAWVMYGTCTQSGERRREKRSVALTPHSGMGLETRAETWMSSEGAWKHAQRVESWILRNPGFALLAGFMAYMIGQTGIQRTVFFILMMLVAPSYGMRCVGVGNRDFVEGVSGGAWVDLVLEHGGCVTTMAQGKPTLDFELIKTTAKEVALLRTYCIEASISNITTATRCPTQGEPYLKEEQDQQYICRRDVVDRGWGNGCGLFGKGGVVTCAKFSCTGKITGNLIQIENLEYTVVVTVHNGDTHAVGNDTSNHGVTATITPRSPSVEVELPDYGELTLDCEPRSGIDFNEMILMKMNKKTWLVHKQWFLDLPLPWAAGADTSEVHWNHKERMVTFKVPHAKRQDVTVLGSQEGAMHSALTGATEVYSGDGNLMFAGHLKCKVRMEKLRIKGMSYTMCSGKFSIDKEMAETQHGTTVVKVKYEGAGAPCKVPIEIRDVNKEKVVGRVISSTPFAENTNSVTNIELEPPFGDSYIVIGVGDSALTLHWFTKGSSIGKMFESTYRGAKRMAILGETAWDFGSVGGLLTSLGKAVHQVFGSVYTTMFGGVSWMVRILIGFLVLWIGTNSRNTSMAMSCIAVGGITLFLGFTVHADMGCAVSWSGKELKCGSGIFIIDNVHTWTEQYKFQPESPARLASAILNAHKDGVCGIRSTTRLENVMWKQITNELNYVLWEGGHDLTVVAGDVKGVLSKGKRALAPPVNDLKYSWKTWGKAKIFTPETRNSTFLIDGPDTSECPNERRAWNFLEVEDYGFGMFTTNIWMKFREGSSEMCDHRLMSAAIKDQKAVHADMGYWIESSKNQTWQIEKASLIEVKTCLWPKTHTLWSNGVLESQMLIPKAYAGPFSQHNYRQGYATQTVGPWHLGKLEIDFGECPGTTVTIQEDCDHRGPSLRTTTASGKLVTQWCCRSCTMPPLRFLGEDGCWYGMEIRPLSEKEENMVKSQVSAGQGTSETFSMGLLCLTLFVEECLRRRVTRKHMILVVVTTLCAIILGGLTWMDLLRALIMLGNTMSSRMGGQIHLAIMAVFKMSPGYVLGIFLRKLTSRETALMVIGMAMTTVLSIPHDLMEFVDGISLGLILLKMVTHFDNTQVGTLALSLTFIKSTMPLVMAWRTIMAVLFVVTLIPLCRTSCLQKQSHWVEITALILGAQALPVYLMTLMKGASKRSWPLNEGIMAVGLVSLLGSALLKNDVPLAGPMVAGGLLLAAYVMSGSSADLSLEKAATVQWDEMADITGSSPIIEVKQDEDGSFSIRDVEETNMITLLVKLALITVSGLYPLAIPVTMTLWYMWQVKTQRSGALWDVPSPAAAQKATLTEGVYRIMQRGLFGKTQVGVGIHMEGVFHTMWHVTRGSVICHESGRLEPSWADVRNDMISYGGGWRLGDKWDKEEDVQVLAVEPGKNPKHVQTKPGLFKTLTGEIGAVTLDFKPGTSGSPIINRKGKVIGLYGNGVVTKSGDYVSAITQAERIGEPDYEVDEDIFRKKRLTIMDLHPGAGKTKRILPSIVREALKRRLRTLILAPTRVVAAEMEEALRGLPIRYQTPAVKSEHTGREIVDLMCHATFTTRLLSSTRVPNYNLIVMDEAHFTDPSSVAARGYISTRVEMGEAAAIFMTATPPGTTDPFPQSNSPIEDIEREIPERSWNTGFDWITDYQGKTVWFVPSIKAGNDIANCLRKSGKKVVQLSRKTFDTEYPKTKLTDWDFVVTTDISEMGANFRAGRVIDPRRCLKPVIITDGPERVILAGPIPVTPASAAQRRGRIGRNPAQEDDQYVFSGDPLRNDEDHAHWTEAKMLLDNIYTPEGIIPTLFGPEREKTQAIDGEFRLRGEQRKTFVELMRRGDLPVWLSYKVASAGISYKDREWCFTGERNNQILEENMEVEIWTREGEKKKLRPKWLDARVYADPVALKDFKEFASGRKSITLDILTEIASLPTYLSSRAKLALDNIVMLHTTERGGKAYQHALNELPESLETLMLIALLGAMTAGIFLFFMQGKGMGKLSMGLIAIAVASGLLWVAEIQPQWIAASIILEFFLMALLIPEPEKQRTPQDNQLIYVILTILTIIGLVAANEMGLIEKTKTDFGFYQEKTETTILDVDLRPASAWTLYAVATTILTPMLRHTIENTSANLSLAAIANQAAVLMGLGKGWPLHRMDLGVPLLAMGCYSQVNPTTLTASLVMLLVHYAIIGPGLQAKATREAQKRTAAGIMKNPTVDGITVIDLEPISYDPKFEKQLGQVMLLVLCAGQLLLMRTTWAFCEVLTLATGPILTLWEGNPGRFWNTTIAVSTANIFRGSYLAGAGLAFSLIKNTQTPRRGTGTTGETLGEKWKRQLNSLDRKEFEEYKRSGILEVDRTEAKSALKDGSKIKYAVSRGTSKIRWIVERGMVKPKGKVVDLGCGRGGWSYYMATLKNVTEVKGYTKGGPGHEEPIPMATYGWNLVKLHSGVDVFYKPTEQVDTLLCDIGESSSNPTIEEGRTLRVLKMVEPWLSSKPEFCIKVLNPYMPTVIEELEKLQRKHGGSLVRCPLSRNSTHEMYWVSGVSRNIVSSVNTTSKMLLNRFTTRYRKPTYEKDADLGAGTRSVSTETEKPDMAIIGRRLQRLQEEHKETWHYDQENPYRTWAYHGSYEAPSTGSASSMVNGVVKLLTKPWDVVPMVTQLAMTDTTPFGQQRVFKEKVDTRTPQPKPGTRMIMTTTANWLWALLGKKKNPRLCTREEFISKVRSNAAIGAVSQEEQGWTSASEAVNDSRFWELVDKERALHQEGKCESCVYNMMGKREKKLGEFGRAKGSRAIWYMWLGARFLEFEALGFLNEDHWFGRENSWSGVEGEGLHRLGYILEDIDKKDGDLIYADDTAGWDTRITEDDLLNEELITEQMAPHHKILAKAIFKLTYQNKVVKVLRPTPKGAVMDIISRKDQRGSGQVGTYGLNTFTNMEVQLIRQMEAEGVITRDDMHNPKGLKERVEKWLKECGVDRLKRMAISGDDCVVKPLDERFSTSLLFLNDMGKVRKDIPQWEPSKGWKNWQEVPFCSHHFHKIFMKDGRSLVVPCRNQDELIGRARISQGAGWSLRETACLGKAYAQMWSLMYFHRRDLRLASMAICSAVPTEWFPTSRTTWSIHAHHQWMTTEDMLKVWNRVWIEDNPNMTDKTPVHSWEDIPYLGKREDLWCGSLIGLSSRATWAKNIHTAITQVRNLIGIEEYVDYMPVMKRYSAPFESEGVL

SEQ ID NO: 5163 - protein, 3288 aa, Artificial Sequence
  derived and/or modified protein sequence (wt) from DENV-4__JQ922558__SS-prME
STLTLLCLIPTVMAFHLSTRDGEPLMIVAKHERGRPLLFKTTEGINKCTLIAMDLGEMCEDTVTYKCPLLVNTEPEDIDCWCNLTSTWVMYGTCTQSGERRREKRSVALTPHSGMGLETRAETWMSSEGAWKHAQRVESWILRNPGFALLAGFMAYMIGQTGIQRTVFFVLMMLVAPSYGMRCVGVGNRDFVEGVSGGAWVDLVLEHGGCVTTMAQGKPTLDFELIKTTAKEVALLRTYCIEASISNITTATRCPTQGEPYLKEEQDQQYICRRDVVDRGWGNGCGLFGKGGVVTCAKFLCLGKITGNLVQIENLEYTVVVTVHNGDTHAVGNDISNHGVTATITPRSPSVEVKLPDYGELTLDCEPRSGIDFNEMILMKMKKKTWLVHKQWVLDLPLPWAAGADTSKVQWNYKERMVTFKVPHAKRQDVTVLGSQEGAMHSALTGATEVDSGDGNHMFAGHLKCKVRMEKLRIKGMSYTMCSGKFSIDKEMAETQHGTTVVKVKYEGAGAPCKVPIEIRDVNKEKVVGRIISSTPFAEHTNSVTNIELEPPFGDSYIVIGVGDSALTLHWFRKGSSIGKMFESTYRGAKRMAILGETAWDFGSVGGLFTSLGKAVHQVFGSVYTTMFGGVSWMVRILIGLLVLWIGTNSRNTSMAMTCIAIGGITLFLGFTVHADMGCAVSWSGKELKCGSGIFVVDNVHTWTEQYKFQPESPARLASAILNAHKDGVCGIRSTTRLENVMWKQITNELNYVLWEGGHDLTVVAGDVKGVLTKGKRALTPPVNDLKYSWKTWGKAKIFTPEARNSTFLIDGPDTSECPNERRAWNFLEVEDYGFGMFTTNIWMKFREGSSEVCDHRLMSAAIKDQKAVHADMGYWIESSKNQPWQIGNASLIEVKTCLWPKTHTLWSNGVLESQMLIPKAYAGPFSQHNYRQGYATQTIGPWHLGKLEIDFGECPGTTVTIQEDCNHRGPSLRTTTASGKLVTQWCCRSCTMPPLRFLGEDGCWYGMEIRPLSEKEENMVKSQVSAGQGTSETFSMGLLCLTLFVEECLRRRVTRKHMILVVVTTLCAIILGGLTWMDLLRALIMLGDTMSGRMGGQIHLTIMAVFKMSPGYVLGVFLRKLTSRETALIVIGMAMTTVLSIPHDLMEFIDGISLGLILLKMVAHFDNTQVGTLALSLTFIRSTMPLVMAWRTIMAVLFVVTLIPLCRTSCLQKQSHWVEITALILGAQALPVYLMTLMKGASKRSWPLNEGIMAVGLVSLLGSALLKNDVPLAGPMVAGGLLLAAYVMSGSSADLSLEKAANVHWDEMADITGSSPIIEVKQDEDGSFSIRDVEETNMITLLVKLALITVSGLYPLAIPVTMTLWYMWQVKTQRSGALWDVPSPAAAQKATLTEGVYRIMQRGLFGKTQVGVGIHMEGVFHTMWHVTRGSVICHETGRLEPSWADVRNDMISYGGGWRLGDKWDKEEDVQVLAIEPGKNPKHVQTKPGLFKTLTGEIGAVTLDFKPGTSGSPIINKKGKVIGLYGNGVVTKSGDYVSAITQAERIGDPDYEVDEDIFRKKRLTIMDLHPGAGKTKRILPSIVREALKRRLRTLILAPTRVVAAEMEEALRGLPIRYQTPAVKSEHTGREIVDLMCHATFTANPLSSTRVPNYNLIVMDEAHLQDLSIVAARGYISTRVEMGEAAAIFMTATPPGATDPFPQSNSPIEDIEREIPERSWNTGFDWITDYQGKTVWFVPSIKAGNDIANCLRKSGKKVIQLSRKTFDTEYPKTKLTDWDFVVTTDISEMGANFRARRVIDPRRCLKPVILTDGPERVILAGPIPVTPASAAQRRGRIGRNPAQEDDQYVFSGDPLKNDEDHAHWTEAKMLLDNIYTPEGIIPTLFGPEREKIQAIDGEFRLRGEQRKTFVELMRRGDLPVWLSYKVASAGISYKDREWCFTGERNNQILEENMEVEIWTREGEKKKLRPKWLDARVYADPMALKDFKEFASGRKSITLDILTEIASLPTYLSSRAKLALDNIVMLHTTERGGRAYQHALNELPESLETLMLVALLGAMTAGIFLFFMQGKGIGKLSMGLMAIAVASGLLWVAEIQPQWIAASIILEFFSMALLIPEPEKQRTPQDNQLIYVILTILTIIGLIAANEMGLIEKTKTDFGFYQVKTETTILDVDLRPASAWTLYAVATTILTPMLRHTIENTSANLSLAAIANQAAVLMGLGKGWPLHRMDLGVPLLAMGCYSQVNPTTLTASLVMLSVHYAIIGPGLQAKATREAQKRSAAGIMKNPTVDGITVIDLEPISYDPKFEKQLGQVMLLALCAGQLLLMRTTWAFCEVLTLATGPILTLWEGNPGRFWNTTIPVSTANIFRGSYLAGAGLAFSLIKNAQTPRRGTGTTGETLGEKWKRQLNSLDRKEFEEYKRSGIFEVDRHEIKYTLKDGSKINHAMSTGSIKIRGIDERGMVKPKGKVVDQGCGRGGWSHYTATAKKVTEVKGYTKGGPGHEEPIPMATYGWNLVKLHSGVDVFYKPTEQVDTLLCDIGESSSNPTIEEGRTLRVLKMVEPWLSSKPEFCIKVLNPYMPTVIEELEKLQRKHGGSLVRCPLSRNSTHEMYWVSGVSGNIVSSVNTTSKMLLNRFTTRHRKPTYEKDVDLGAGTRSVSIETEKPDMTIIGRRLQRLREEHKETWHYDQENPYRTWAYHGSYEAPSTGSASSMVNGVVKLLTKPWDVIPMVTQLAMTDTTPFGQQREFKEKVYTSTPHPKPWTRMVMTTTANWLWALGGKKKSPRLCTWEEFISKVRSNAAIGAVFQEEQGWTSASEAVNDSRFWELVDKERALHQEGKCESCVYNMMGKREKKLGEFGRAKGSRAIWYMWLGARFLEFEALGFLNEDHWFGRENSWSGVEGEGLHRLGYILEDIDKKDGDLIYADDTAGWDTRITEDDLLNEELITEQMAPHHRILAKAIFKLTYHSKVMKVLRPTPKGAVMDIISRKDQRGSGQVGTYGLNTFTNMEVQLIRQMEAEGVITQDDMQNPKGLKERVEKWLKECGVDRLKRMAISGDDCVVKPLDERFSTSLLFLNDMGKVRKDIPQWEPSKGWKNWQEVPFCSHHFHKIFMKDGRSLVVPCRNQDELIGRARISQGAGWSLRETACLGKAYAQMWSLMYFHRRDLRLASMAICSAVPTEWFPTSRTTWSIHAHHQWMTTEDMLKVWNRVWIEDNPNMTDKTPVHSWEDVPYLGKREDLWCGSLIGLSSRATWAKNIHTAITQVRNLIGKEEYVDYMPVMKRYSAPIESEGVL

SEQ ID NO: 5164 - protein, 3288 aa, Artificial Sequence
  derived and/or modified protein sequence (wt) from DENV-4__JQ922559__SS-prME
STITLLCLIPTVMAFHLSTRDGEPLMIVAKHERGRPLLFKTTEGINKCTLIAMDLGEMCEDTVTYKCPLLVNTEPEDIDCWCNLTSAWVMYGTCTQSGERRREKRSVALTPHSGMGLETRAETWMSSEGAWKHAQRVESWILRNPGFALLAGFMAYMIGQTGIQRTVFFILMMLVAPSYGMRCVGVGNRDFVEGVSGGAWVDLVLEHGGCVTTMAQGKPTLDFELIKTTAKEVALLRTYCIEASISNITTATRCPTQGEPYLKEEQDQQYICRRDVVDRGWGNGCGLFGKGGVVTCAKFLCSGKITGNLVQIENLEYTVVVTVHNGDTHAVGNDISIHGVTATITPRSPSVEVKLPDYGELTLDCEPRSGIDFNEMILMKMKKKTWLVHKQWFLDLPLPWTAGADTSEVQWNYKERMVTFKVPHAKRQDVTVLGSQEGAMHSALTGATEVDSGDGNHMFAGHLKCKVRMEKLRIKGMSYTMCSGKFSIDKEMAETQHGTTVVKVKYEGAGAPCKVPIEIRDVNKEKVVGRIISSTPFAENTYSVTNIELEPPFGDSYIIIGVGDSALTLHWFRKGSSIGKMFESTYRGAKRMAILGETAWDFGSVGGLLTSLGKAVHQVFGSVYTTMFGGVSWMVRILIGLLVLWIGTNSRNTSMAMSCIAVGGITLFLGFTVHADMGCAVSWSGKELKCGSGIFVIDNVHTWTEQYKFQPESPARLASAILNAHKDGVCGIRSTTRLENVMWKQITNELNYVLWEGGHDLTIVAGDVKGVLSKGKRALAPPVNDLKYSWKTWGKAKIFTPETRNSTFLIDGPDTSECPNERRAWNFLEVEDYGFGMFTTNIWMKFREGSSEVCDHRLMSAAIKDQKAVHADMGYWIESSKNQTWQIEKASLIEVKTCLWPKTHTLWSNGVLESQMLIPKAYAGPFSQHNYRQGYATQTVGPWHLGKLEIDFGECPGTTVTIQEDCDHRGPSLRTTTASGKLVTQWCCRSCTMPPLRFLGEDGCWYGMEIRPLSEREENMVKSQVSAGQGTSETFSMGLLCLTLFVEECLRRRVTRKHMILVVVTTLCAIILGGLTWMDLLRALIMLGDTMSSRMGGQIHLAIMAVFKMSPGYVLGIFLRKLTSRETALMVIGMAMTTVLSIPHDLMEFIDGISLGLILLKMVTHFDNTQMGTLALSLTFIKSTMPLVMAWRTIMAVLFVVTLIPLCRTSCLQKQSHWVEITALILGAQALPVYLMTLMKGASKRSWPLNEGIMAVGLVSLLGSALLKNDVPLAGPMVAGGLLLAAYVMSGSSADLSLEKAANVQWDEMADITGSSPIIEVKQDEDGSFSIRDVEETNMITLLVKLALITVSGLYPLAIPVTMTLWYMWQVKTQRSGALWDVPSPAAAQKATLTEGVYRIMQRGLFGKTQVGVGIHMEGVFHTMWHVTRGSVICHESGRLEPSWADVRNDMISYGGGWRLGDKWDKEEDVQVLAIEPGKNPKHVQTKPGLFKTLTGEIGAVTLDFKPGTSGSPIINRKGKVIGLYGNGVVTKSGDYVSAITQAERIGEPDYEVDEDIFRKKRLTIMDLHPGAGKTKRILPSIVREALKRRLRTLILAPTRVVAAEMEEALRGLPIRYQTPAVLSEHTGREIVDLMCHATFTTRLLSSTRVPNYNLIVMDEAHFTDPSSVAARGYISTRVEMGEAAAIFMTATPPGTTDPFPQSNSPIEDIEREIPERSWNTGFDWITDYQGKTVWFVPSIKAGNDIANCLRKSGKKVIQLSRKTFDTEYPKTKLTDWDFVVTTDISVMGANFRAGRVIDPRRCLKPVIITDGPERVILAGPIPVTPASAAQRRGRIGRNPAQEDDQYVFSGDPLRNDEDHAHWTEAKMLLDNIYTPEGIIPTLFGPEREKTQAIDGEFRLRGEQRKTFVELMRRGDLPVWLSYKVASAGISYKDREWCFTGERNNQILEENMEVEIWTREGEKKKLRPKWLDARVYADPMALKDFKEFASGRKSITLDILTEIASLPTYLSSRAKLALDNIVMLHTTERGGKAYQHALNELPESLETLMLVALLGAMTAGIFLFFMQGKGIGELSMGLIAIAGASGLLWGTKTPPPWGAASNILEFFLMVLLIPEPEKQRTPQDNQLIYVILTILTIIGLVAANEMGLIEKTKTDFGFYQVKTETTILDVDLRPASAWTLYAVATTILTPMLRHTIENTSANLSLAAIANQAAVLMGLGKGWPLHRMDLGVPLLAMGCYSQVNPTTLIASLVMLLVHYAIIGPGLQAKATREAQKRTAAGIMKNPTVDGITVIDLEPISYDPKFEKQLGQVMLLVLCAGQLLLMRTTWAFCEVLTLATGPILTLWEGNPGRFWNTTIAVSTANIFRGSYLAGAGLAFSLIKNAQTPRRGTGVTGETLGEKWKRQLNSLDRKEFEEYKRSGILEVDRTEAKSALKDGSKIKQAVSRGTSKIRWIVERGMVKPKGKVVDLGCGRGGWSYYMATLKNVTEVKGYTKGGPGHEEPIPMATYGWNLVKLHSRVDVFYKPTEQVDTLLCDIGESSSNPTIEEGRTLRVLKMVEPWLSSKPEFCIKVLNPYMPTVIEELEKLQRKHGGSLVRCPLSRNSTHEMYWVSGVSGNIVSSVNTTSKMLLNRFTTKHRKPTYEKDADLGAGTRSVSTETEKPDMTIIGRRLQRLQEEHQETWHYDQENPYRTWAYHGGYEAPSTGSASSMVNGVVKLLTKPWDVIPMVTQLAMTDTTPFGQQRVFKEKVDTRTPQPKPGTRMVMTTTANWLWALLGKKKNPRLCTREEFISKVRSNAAIGAVSQEEQGWTSSFEAVNDSRFWELVDKERALHQEGKCESCVYNMMGKREKKLGEFGRAKGSRAIWYMWLGARFLEFEALGFLNEDHWFGRENSWSGVEGEGLHRLGYILEDLDKRDRSLVFADDTAGWDTKIPEDDLLKEKPIPGPMAPHQRIPARAIFKLTYQNKVVKVLRLKLKGAVMDIISRKEQRGSGQVGTYGLNTFTNMEVQLIRQMEAEGVITRDDMHNPKGLKERVEKWLKECGVDRLERMAISGDDCVVKPLDERFSTSLLFLNDMGKVRKDIPQWEPSKGWKNWQEVPFCSHHFHKIFMKDGRSLVVPCRNQDELIGRARISQGAGWSLRETACLGKAYAQMWSLMYFHRRDLRLASMAICSAVPTEWFPTSRTTWSIHAHHQWMTTEDMLKVWNRVWIEDNPNMTDKTPVHSWEDIPYLGKREDLWCGSLIGLSSRATWAKNIHTAITQVRNLIGIEGYVDYFLLIKWYSAPFESEGVL

SEQ ID NO: 5165 - protein, 3288 aa, Artificial Sequence
  derived and/or modified protein sequence (wt) from DENV-4__KF955510__SS-prME
STITLLCLIPTVMAFHLSTRDGEPLMIVAKHERGRPLLFKTTEGINKCTLIAMDLGEMCEDTVTYKCPLLVNTEPEDIDCWCNLTSAWVMYGTCTQSGERRREKRSVALTPHSGMGLETRTETWMSSEGAWKHAQRVESWILRKPGFALSAGFMAYMIGQTGIQRTVFFILMMLVAPSYGMRCVGVGNRDFVEGVSGGAWVDLVLEHGGCVTTMAQGKPTLDFELIKTTAKEVALLRTYCIEASISNITTATRCPTQGEPYLKEEQDQQYICRRDMVDRGWGNGCGLFGKGGVVTCAKFSCSGKITGNLVQIENLEYTVVVTVHNGDTHAVGNDTSNHGETATITPRSPSVEVRLPDYGELTLDCEPRSGIDFNEMILMKMKTKTWLVHKQWFLDLPLPWTAGADTSEVHWNHKERMVTFKVPHAKRQDVTVLGSQEGAMHSALAGATEVDSGDGNHMFAGHLKCKVRMEKLRIKGMSYTMCSGKFSIDKEMAETQHGTTVVKVKYEGTGAPCKVPIEIRDVNKEKVVGRIISSTPFAENTNSVTNIELEPPFGDSYIVIGAGDSALTLHWFRKGSSIGKMFESTYRGAKRMAILGETAWDFGSVGGLLTSLGKAVHQVFGSVYTTMFGGVSWMVRILIGLLVLWIGTNSRNTSMAMSCIVVGGITLFLGFTVHADMGCVVSWSGKELKCGSGIFVIDNVHTWTEQYKFQPESPARLASAILNAHKDGVCGIRSTTRLENVMWKQITNELNYVLWEGGHDLTVVAGDVKGVLSKGKRALAPPVNDLKYSWKTWGKAKIFTPETRNSTFLVDGPDTSECPNERRAWNFLEVEDYGFGMFTTNIWMKFREGSSEVCDHRLMSAAIKDQKAVHADMGYWIESSKNQTWQIEKASLIEVKTCLWPKTHTLWSNGVLESQMLIPKAYAGPISQHNYRQGYATQTVGPWHLGKLEIDFGECPGTTVTIQEDCDHRGPSLRTTTASGKLVTQWCCRSCTMPPLRFLGEDGCWYGMEIRPLNEKEENMVKSQVSAGQGTSETFSMGLLCLTLFVEECLRRRVTRKHMILVVVTTLCAIILGGLTWMDLLRALIMLGDTMSGRMGGQIHLAIMAMFKMSPGYVLGIFLRKLTSRETALMVIGMAMTTVLSIPHDLMEFIDGISLGLILLKMVTHFDNTQVGTLALSLTFIKSTMPLVMAWRTIMAVLFVVTLIPLCRTSCLQKQSHWVEITALILGAQALPVYLMTLMKGASKRSWPLNEGIMAVGLVSLLGSALLKNDVPLAGPMVAGGLLLAAYVMSGSSADLSLEKAANVQWDEMADITGSSPIIEVKQDEDGSFSIRDVEETNMITLLVKLALITVSGLYPLAIPVTMTLWYMWQVKTQRSGALWDVPSPAAAQKATLTEGAYRIMQRGLFGKTQVGVGIHMEGVFHTMWHVTRGSVICHESGRLEPSWADVRNDMISYGGGWRLGDKWDKEEDVQVLAIEPGKNPKHVQTKPGLFKTLTGEIGAVTLDFKPGTSGSPIINRKGKVIGLYGNGVVTKSGDYVSAITQAERIGEPDYEVDEDIFRKKRLTIMDLHPGAGKTKRILPSIVREALKRRLRTLILAPTRVVAAEMEEALRGLPIRYQTPAVKSEHTGREIVDLMCHATFTTRLLSSTRVPNYNLIVMDEAHFTDPSSVAARGYISTRVEMGEAAAIFMTATPPGTTDPFPQSNSPIEDIEREIPERSWNTGFDWITDYQGKTVWFVPSIKAGNDIANCLRKSGKKVIQLSRKTFDTEYPKTKLTDWDFVVTTDISEMGANFRAGRVIDPRRCLKPVILTDGPERVILAGPIPVTPASAAQRRGRIGRNPAQEDDQYVFSGDPLRNDEDHAHWTEAKMLLDNIYTPEGIIPTLFGPEREKTQAIDGEFRLRGEQRKTFVELMRRGDLPVWLSYKVASAGISYKDREWCFTGERNNQILEENMEVEIWTREGEKKKLRPKWLDARVYADPMALKDFKEFASGRKSITLDILTEIASLPTYLSSRAKLALDNIVMLHTTERGGKAYQHALNELPESLETLMLVALLGAMTAGIFLFFMQGKGMGKLSMGLIAIAVASGLLWVAEIQPQWIAASIILEFFLMVLLVPEPEKQRTPQDNQLIYVILTILTIIALVAANEMGLIEKTKTDFGFYQAKTETTILDVDLRPASAWTLYAVATTILTPMLRHTIENTSANLSLAAIANQAAVLMGLGKGWPLHRMDLGVPLLAMGCYSQVNPTTLTASLVMLLVHYAIIGPGLQAKATREAQKRTAAGIMKNPTVDGITVIDLEPISYDPKFEKQLGQVMLLVLCAGQLLLMRTTWAFCEVLTLATGPILTLWEGNPGRFWNTTIAVSTANIFRGSYLAGAGLAFSLIKNAQTPRRGTGTTGETLGEKWKRQLNSLDRKGFEEYKRSGILEVDRTEAKSALKDGSKIKYAVSRGTSKIRWIVERGMVKPKGKVVDLGCGRGGWSYYMATLKNVTEVKGYTKGGPGHEEPIPMATYGWNLVKLHSGVDVFYKPTEQVDTLLCDIGESSSNPTIEEGRTLRVLKMVEPWLSSKPEFCIKVLNPYMPTVIEELEKLQRKHGGSLVRCPLSRNSTHEMYWVSGVSGNIVSSVNTTSKMLLNRFTTRHRKPTYEKDADLGAGTRSVSTETEKPDMTIIGRRLQRLQEEHKETWHYDHENPYRTWAYHGSYEAPSTGSASSMVNGVVKLLTKPWDVVPMVTQLAMTDTTPFGQQRVFKEKVDTRTPQPKPGTRVVMTTTANWLWALLGRKKNPRLCTREEFISKVRSNAAIGAVFQEEQGWTSASEAVNDSRFWELVDKERALHQEGKCESCVYNMMGKREKKLGEFGRAKGSRAIWYMWLGARFLEFEALGFLNEDHWFGRENSWSGVEGEGLHRLGYILEDIDKKDGDLIYADDTAGWDTRITEDDLLNEELITEQMAPHHKILAKAIFKLTYQNKVVKVLRPTPKGAVMDIISRKDQRGSGQVGTYGLNTFTNMEVQLIRQMEAEGVITRDDMHNPKGLKERVEKWLKECGVDRLKRMAISGDDCVVKPLDERFSTSLLFLNDMGKVRKDIPQWEPSKGWKNWQEVPFCSHHFHKIFMKDGRSLVVPCRNQDELIGRARISQGAGWSLRETACLGKAYAQMWSLMYFHRRDLRLASMAICSAVPTEWFPTSRTTWSIHAHHQWMTTEDMLKVWNRVWIEDNPNMIDKTPVHSWEDIPYLGKREDLWCGSLIGLSSRATWAKNIHTAITQVRNLIGKEEYVDYMPVMKRYSAHFESEGVL

SEQ ID NO: 5166 - protein, 3288 aa, Artificial Sequence
  derived and/or modified protein sequence (wt) from DENV-4__GQ868594__SS-prME
STMTLLCLIPTVMAFHLSTRDGEPLMIVAKHERGRPLLFKTTEGINKCTLIAMDLGEMCEDTVTYECPLLVNTEPEDIDCWCNLTSAWVMYGTCTQSGERRREKRSVALTPHSGMGLETRAETWMSSEGAWKHAQRVESWILRNPGFALLAGFMAYMIGQTGIQRTVFFVLMMLVAPSYGMRCVGVGNRDFVEGVSGGAWVDLVLEHGGCVTTMAQGKPTLDFELIKTTAKEVALLRTYCIEASISNITTATRCPTQGEPYLKEEQDQQYICRRDVVDRGWGNGCGLFGKGGVVTCAKFSCSGKITGNLVQIENLEYTVVVTVHNGDTHAVGNDIPNHGVTATITPRSPSVEVKLPDYGELTLDCEPRSGIDFNEMILMKMKKKTWLVHKQWFLDLPLPWAAGADTSEVHWNYKERMVTFKVPHAKRQDVIVLGSQEGAMHSALTGATEVDSGDGNHMFAGHLKCKVRMEKLRIKGMSYTMCSGKFSIDKEMAETQHGTTVVKVKYEGAGAPCKVPIEIRDVNKEKVVGRIISSTPFAEYTNSVTNIELEPPFGDSYIVIGVGDSALTLHWFRKGSSIGKMLESTYRGAKRMAILGETAWDFGSVGGLLTSLGKAVHQVFGSVYTTMFGGVSWMVRILIGFLVLWIGTNSRNTSMAMTCIAVGGITLFLGFTVHADTGCAVSWSGKELKCGSGIFVIDNVHTWTEQYKFQPESPARLASAILNAHKDGVCGIRSTTRLENIMWKQITNELNYVLWEGGHDLTVVAGDVKGVLSKGKRALAPPVNDLKYSWKTWGKAKIFTPEAKNSTFLIDGPDTSECPNERRAWNFLEVEDYGFGMFTTNIWMKFREGSSEVCDHRLMSAAIKDQKAVHADMGYWIESSKNQTWQIEKASLIEVKTCLWPKTHTLWSNGVLESQMLIPKAYAGPFSQHNYRQGYATQTVGPWHLGKLEIDFGECPGTTVTIQEDCDHRGPSLRTTTASGKLVTQWCCRSCTMPPLRFLGEDGCWYGMEIRPLSEKEENMVKSQVSAGQGTSETFSMGLLCLTLFVEECLRRRVTRKHMILVVVTTLCAIILGGLTWMDLLRALIMLGDTMSGRMGGQIHLAIMAVFKMSPGYVLGIFLRKLTSRETALMVIGMAMTTVLSIPHDLMEFIDGISLGLILLKMVTHFDNTQVGTLALSLTFIRSTMPLVMAWRTIMAVLFVVTLIPLCRTSCLQKQSHWVEITALILGAQALPVYLMTLMKGASKRSWPLNEGIMAVGLVSLLGSALLKNDVPLAGPMVAGGLLLAAYVMSGSSADLSLEKAANVQWDEMADITGSSPIIEVKQDEDGSFSIRDIEETNMITLLVKLALITVSGLYPLAIPVTMTLWYMWQVKTQRSGALWDVPSPAAAQKATLTEGVYRIMQRGLFGKTQVGVGIHMEGVFHTMWHVTRGSVICHETGRLEPSWADVRNDMISYGGGWRLGDKWDKEEDVQVLAIEPGKNPKHVQTKPGLFKTLTGEIGAVTLDFKPGTSGSPIINRKGKVIGLYGNGVVTKSGDYVSAITQAERTGEPDYEVDEDIFRKKRLTIMDLHPGAGKTKRILPSIVREALKRRLRTLILAPTRVVAAEMEEALRGLPIRYQTPAVKSEHTGREIVDLMCHATFTTRLLSSTRVPNYNLIVMDEAHFTDPSSVAARGYISTRVEMGEAAAIFMTATPPGATDPFPQSNSPIEDIEREIPERSWNTGFDWITDYQGKTVWFVPSIKAGNDIANCLRKSGKKVIQLSRKTFDTEYPKTKLTDWDFVVTTDISEMGANFRAGRVIDPRRCLKPVISTDGPERVILAGPIPVTPASAAQRRGRIGRNPAQEDDQYVFSGDPLKNDEDHAHWTEAKMLLDNIYTPEGIIPTLFGPEREKNQAIDGEFRLRGEQRKTFVELMRRGDLPVWLSYKVASAGISYKDREWCFTGERNNQILEENMEVEIWTREGEKKKLRPKWLDARVYADPMALKDFKEFASGRKSITLDILTEIASLPTYLSSRAKLALDNIVMLHTTERGGKAYQHALNELPESLETLMLVALLGAMTAGIFLFFMQGKGIGKLSMGLIAIAVASGLLWVAEIQPQWIAASIILEFFLMVLLIPEPEKQRTPQDNQLIYVILTILTIIGLIAANEMGLIEKTKTDFGFYQVKTETTILDVDLRPASAWTLYAVATTILTPMLRHTIENTSANLSLAAIANQAAVLMGLGKGWPLHRMDLGVPLLAMGCYSQVNPTTLIASLVMLLVHYAIIGPGLQAKATREAQKRTAAGIMKNPTVDGITVIDLEPISYDPKFEKQLGQVMLLVLCAGQLLLMRTTWAFCEVLTLATGPVLTLWEGNPGRFWNTTIAVSTANIFRGSYLAGAGLAFSLIKNAQTPRRGTGTTGETLGEKWKRQLNSLDRKEFEEYKRSGILEVDRTEAKSALKDGSKIKHAVSRGSSKIRWIVERGMVKPKGKVVDLGCGRGGWSYYMATLKNVTEVKGYTKGGPGHEEPIPMATYGWNLVKLHSGVDVFYKPTEQVDTLLCDIGESSSNPTIEEGRTLRVLKMVEPWLSSKPEFCIKVLNPYMPTVIEELEKLQRKHGGSLVRCPLSRNSTHEMYWVSGVSGNIVSSVNTTSKMLLNRFTTRHRKPTYEKDVDLGAGTRSVSTETEKPDMTIIGRRLQRLQEEHKETWHYDQENPYRTWAYHGSYEAPSTGSASSMVNGVVKLLTKPWDVIPMVTQLAMTDTTPFGQQRVFKEKVDTRTPQPKPGTRMVMTTTANWLWALLGKKKNPRLCTREEFISKVRSNAAIGAVFQEEQGWTSASEAVNDSRFWELVDKERALHQEGKCESCVYNMMGKREKKLGEFGRAKGSRAIWYMWLGARFLEFEALGFLNEDHWFGRENSWSGVEGEGLHRLGYILEDIDKKDGDLIYADDTAGWDTRITEDDLLNEELITEQMAPHHKILAKAIFKLTYQNKVVKVLRPTPKGAVMDIISRKDQRGSGQVGTYGLNTFTNMEVQLIRQMEAEGVITQDDMHNPKGLKERVEKWLKECGVDRLKRMAISGDDCVVKPLDERFSTSLLFLNDMGKVRKDIPQWEPSKGWKNWQEVPFCSHHFHKIFMKDGRSLVVPCRNQDELIGRARISQGAGWSLRETACLGKAYAQMWSLMYFHRRDLRLASMAICSAVPTEWFPTSRTTWSIHAHHQWMTTEDMLKVWNRVWIEDNPNMTDKTPVHSWEDIPYLGKREDLWCGSLIGLSSRATWAKNIHTAITQVRNLIGKEEYVDYMPVMKRYSAPFESEGVL

SEQ ID NO: 5167 - protein, 3288 aa, Artificial Sequence
  derived and/or modified protein sequence (wt) from DENV-4__FJ024424__SS-prME
STITLLCLIPTVMAFHLSTRDGEPLMIVAKHERGRPLLFKTTEGINKCTLIAMDLGEMCEDTVTYKCPLLVNTEPEDIDCWCNLTSTWVMYGTCTQSGERRREKRSVALTPHSGMGLETRAETWMSSEGAWKHAQRVESWILRNPGFALLAGFMAYMIGQTGIQRTVFFVLMMLVAPSYGMRCVGVGNRDFVEGVSGGAWVDLVLEHGGCVTTMAQGKPTLDFELTKTTAKEVALLRTYCIEASISNITTATRCPTQGEPYLKEEQDQQYICRRDVVDRGWGNGCGLFGKGGVVTCAKFSCSGKITGNLVQIENLEYTVVVTVHNGDTHAVGNDTSNHGVTTTITPRSPSVEVKLPDYGELTLDCEPRSGIDFNEMILMKMKKKTWLVHKQWFLDLPLPWTAGADTSEVHWNYKERMVTFKVPHAKRQDVTVLGSQEGAMHSALAGATEVDSGDGNHMFAGHLKCKVRMEKLRIKGMSYTMCSGKFSIDKEMAETQHGTTVVKVKYEGAGAPCKVPIEIRDVNKEKVVGRVISSTPLAENTNSVTNIELEPPFGDSYIVIGVGNSALTLHWFRKGSSIGKMFESTYRGAKRMAILGETAWDFGSVGGLFTSLGKAVHQVFGSVYTTMFGGVSWMIRILIGFLVLWIGTNSRNTSMAMTCIAVGGITLFLGFTVQADMGCVVSWSGKELKCGSGIFVVDNVHTWTEQYKFQPESPARLASAILNAHKDGVCGIRSTTRLENVMWKQITNELNYVLWEGGHDLTVVAGDVKGVLTKGKRALTPPVSDLKYSWKTWGKAKIFTPEARNSTFLIDGPDTSECPNERRAWNSLEVEDYGFGMFTTNIWMKFREGSSEVCDHRLMSAAIKDQKAVHADMGYWIESSKNQTWQIEKASLIEVKTCLWPKTHTLWSNGVLESQMLIPKSYAGPFSQHNYRQGYATQTVGPWHLGKLEIDFGECPGTTVTIQEDCDHRGPSLRTTTASGKLVTQWCCRSCTMPPLRFLGEDGCWYGMEIRPLSEKEENMVKSQVAAGQGTSETFSMGLLCLTLFVEECLRRRVTRKHMILAVVITLCAIILGGLTWMDLLRALIMLGDTMSGRIGGQTHLAIMAVFKMSPGYVLGVFLRKLTSRETALMVIGMAMTTTLSIPHDLMELIDGISLGLILLKIVTQFDNTQVGTLALSLTFIRSTMSLVMAWRTIMAVLFVVTLIPLCRTSCLQKQSHWVEITALILGAQALPVYLMTLMKGASRRSWPLNEGIMAVGLVSLLGSALLKNDVPLAGPMVAGGLLLAAYVMSGSSADLSLEKAANVQWDEMADITGSSPIIEVKQDEDGSFSIRDVEETNMITLLVKLALITVSGLYPLAIPVTMTLWYMWQVKTQRSGALWDVPSPAATQKAALSEGVYRIMQRGLFGKTQVGVGIHMEGVFHTMWHVTRGSVICHETGRLEPSWADVRNDMISYGGGWRLGDKWDKEEDVQVLAIEPGKNPKHVQTKPGLFKTLTGEIGAVTLDFKPGTSGSPIINRKGKVIGLYGNGVVTKSGDYVSAITQAERIGEPDYEVDEDIFRKKRLTIMDLHPGAGKTKRILPSIVREALKRRLRTLILAPTRVVAAEMEEALRGLPIRYQTPAVKSEHTGREIVDLMCHATFTTRLLSSTRVPNYNLIVMDEAHFTDPSSVAARGYISTRVEMGEAAAIFMTATPPGATDPFPQSNSPIEDIEREIPERSWNTGFDWITDYQGKTVWFVPSIKAGNDIANCLRKSGKKVIQLSRKTFDTEYPKTKLTDWDFVVTTDISEMGANFRAGRVIDPRRCLKPVILTDGPERVILAGPIPVTPASAAQRRGRIGRNPTQEDDQYVFSGDPLKNDEDHAHWTEAKMLLDNIYTPEGIIPTLFGPEREKTQAIDGEFRLRGEQRKTFVELMRRGDLPVWLSYKVASAGISYKDREWCFTGERNNQILEENMEVEIWTREGEKKKLRPRWLDARVYADPMALKDFKEFASGRKSITLDILTEIASLPTYLSSRAKLALDNIVMLHTTERGGRAYQHALNELPESLETLMLVALLGAMTAGIFLFFMQGKGIGKLSMGLITIAVASGLLWVAEIQPQWIAASIILEFFLMVLLIPEPEKQRTPQDNQLIYVILTILTIIGLIAANEMGLIEKTKTDFGFYQVKTETTILDVDLRPASAWTLYAVATTILTPMLRHTIENTSANLSLAAIANQAAVLMGLGKGWPLHRMDLGVPLLAMGCYSQVNPTTLTASLVMLLVHYAIIGPGLQAKATREAQKRTAAGIMKNPTVDGITVIDLEPISYDPKFEKQLGQVMLLVLCAGQLLLMRTTWAFCEVLTLATGPILTLWEGNPGRFWNTTIAVSTANIFRGSYLAGAGLAFSLIKNAQTPRRGTGTTGETLGEKWKRQLNSLDRKEFEEYKRSGILEVDRTEAKSALKDGSKIKHAVSRGSSKIRWIVERGMVKPKGKVVDLGCGRGGWSYYMATLKNVTEVKGYTKGGPGHEEPIPMATYGWNLVKLHSGVDVFYKPTEQVDTLLCDIGESSSNPTIEEGRTLRVLKMVEPWLSSKPEFCIKVLNPYMPTVIEELEKLQRKHGGNLVRCPLSRNSTHEMYWVSGASGNIVSSVNTTSKMLLNRFTTRHRKPTYEKDVDLGAGTRSVSTETEKPDMTIIGRRLQRLQEEHKETWHYDQENPYRTWAYHGSYEAPSTGSASSMVNGVVKLLTKPWDMIPMVTQLAMTDTTPFGQQRVFKEKVDTRTPQPKPGTRMVMTTTANWLWALLGKKKNPRLCTREEFISKVRSNAAIGAVFQEEQGWTSASEAVNDSRFWELVDKERALHQEGKCESCVYNMMGKREKKLGEFGRAKGSRAIWYMWLGARFLEFEALGFLNEDHWFGRENSWSGVEGEGLHRLGYILEEIDKKDGDLMYADDTAGWDTRITEDDLQNEELITEQMAPHHKILAKAIFKLTYQNKVVKVLRPTPRGAVMDIISRKDQRGSGQVGTYGLNTFTNMEVQLIRQMEAEGVITQDDMQNPKGLKERVEKWLRECGVDRLKRMAISGDDCVVKPLDERFGTSLLFLNDMGKVRKDIPQWEPSKGWKNWQEVPFCSHHFHKIFMKDGRSLVVPCRNQDELIGRARISQGAGWSLRETACLGKAYAQMWSLMYFHRRDLRLASMAICSAVPTEWFPTSRTTWSIHAHHQWMTTEDMLKVWNRVWIEDNPNMIDKTPVHSWEDIPYLGKREDLWCGSLIGLSSRATWAKNIHTAITQVRNLIGKEEYVDYMPVMKRYSAPSESEGVL

SEQ ID NO: 5168 - protein, 3288 aa, Artificial Sequence
  derived and/or modified protein sequence (wt) from DENV-4__EU854295__SS-prME
STITLLCLIPTVMAFHLSTRDGEPLMIVAKHERGRPLLFKTTEGINKCTLIAMDLGEMCEDTVTYKCPLLVNTEPEDIDCWCNLTSTWVMYGTCTQSGERRREKRSVALTPHSGMGLETRAETWMSSEGAWKHAQRVESWILRNPGFALLAGFMAYMIGQTGIQRTVFFVLMMLVAPSYGMRCVGVGNRDFVEGVSGGAWVDLVLEHGGCVTTMAQGKPTLDFELTKTTAKEVALLRTYCIEASISNITTATRCPTQGEPYLKEEQDQQYICRRDVVDRGWGNGCGLFGKGGVVTCAKFSCSGKITGNLVQIENLEYTVVVTVHNGDTHAVGNDTSNHGVTATITPRSPSVEVKLPDYGELTLDCEPRSGIDFNEMILMKMKKKTWLVHKQWFLDLPLPWTAGADTSEVHWNYKERMVTFKVPHAKRQDVTVLGSQEGAMHSALAGATEVDSGDGNHMFAGHLKCKVRMEKLRIKGMSYTMCSGKFSIDKEMAETQHGTTVVKVKYEGAGAPCKVPIEIRDVNKEKVVGRVISSTPLAENTNSVTNIELEPPFGDSYIVIGVGNSALTLHWFRKGSSIGKMFESTYRGAKRMAILGETAWDFGSVGGLFTSLGKAVHQVFGSVYTTMFGGVSWMIRILIGFLVLWIGTNSRNTSMAMTCIAVGGITLFLGFTVQADMGCVVSWSGRELKCGSGIFVVDNVHTWTEQYKFQPESPARLASAILNAHKDGVCGIRSTTRLENVMWKQITNELNYVLWEGGHDLTVVAGDVKGVLTKGKRALTPPVSDLKYSWKTWGKAKIFTPEARNSTFLIDGPDTSECPNERRAWNSLEVEDYGFGMFTTNIWMKFREGSSEVCDHRLMSAAIKDQKAVHADMGYWIESSKNQTWQIEKASLIEVKTCLWPKTHTLWSNGVLESQMLIPKSYAGPFSQHNYRQGYATQTVGPWHLGKLEIDFGECPGTTVTIQEDCDHRGPSLRTTTASGKLVTQWCCRSCTMPPLRFLGEDGCWYGMEIRPLSEKEENMVKSQVAAGPGTSETFSMGLLCLTLFVEECLRRRVTRKHMILAVVITLCAIILGGLTWMDLLRALIMLGDTMSGRIGGQTHLAIMAVFKMSPGYVLGVFLRKLTSRETALMVIGMAMTTTLSIPHDLMELIDGISLGLILLKIVTQFDNTQVGTLALSLTFIRSTMSLVMAWRTIMAVLFVVTLIPLCRTSCLQKQSHWVEITALILGAQALPVYLMTLMKGASRRSWPLNEGIMAVGLVSLLGSALLKNDVPLAGPMVAGGLLLAAYVMSGSSADLSLEKAANVQWDEMADITGSSPIIEVKQDEDGSFSIRDVEETNMITLLVKLALITVSGLYPLAIPVTMTLWYMWQVKTQRSGALWDVPSPAATQKAALSEGVYRIMQRGLFGKTQVGVGIHMEGVFHTMWHVTRGSVICHETGRLEPSWADVRNDMISYGGGWRLGDKWDKEEDVQVLAIEPGKNPKHVQTKPGLFKTLTGEIGAVTLDFKPGTSGSPIINRKGKVIGLYGNGVVTKSGDYVSAITQAERIGEPDYEVDEDIFRKKRLTIMDLHPGAGKTKRILPSIVREALKRRLRTLILAPTRVVAAEMEEALRGLPIRYQTPAVKSEHTGREIVDLMCHATFTTRLLSSTRVPNYNLIVMDEAHFTDPSSVAARGYISTRVEMGEAAAIFMTATPPGATDPFPQSNSPIEDIEREIPERSWNTGFDWITDYQGKTVWFVPSIKAGNDIANCLRKSGKKVIQLSRKTFDTEYPKTKLTDWDFVVTTDISEMGANFRAGRVIDPRRCLKPVILTDGPERVILAGPIPVTPASAAQRRGRIGRNPAQEDDQYVFSGDPLKNDEDHAHWTEAKMLLDNIYTPEGIIPTLFGPEREKTQAIDGEFRLRGEQRKTFVELMRRGDLPVWLSYKVASAGISYKDREWCFTGERNNQILEENMEVEIWTREGEKKKLRPRWLDARVYADPMALKDFKEFASGRKSITLDILTEIASLPTYLSSRAKLALDNIVMLHTTERGGRAYQHALNELPESLETLMLVALLGAMTAGIFLFFMQGKGIGKLSMGLITIAVASGLLWVAEIQPQWIAASIILEFFLMVLLIPEPEKQRTPQDNQLIYVILTILTIIGLIAANEMGLIEKTKTDFGFYQVKTETTILDVDLRPASAWTLYAVATTILTPMLRHTIENTSANLSLAAIANQAAVLMGLGKGWPLHRMDLGVPLLAMGCYSQVNPTTLTASLVMLLVHYAIIGPGLQAKATREAQKRTAAGIMKNPTVDGITVIDLEPISYDPKFEKQLGQVMLLVLCAGQLLLMRTTWAFCEVLTLATGPILTLWEGNPGRFWNTTIAVSTANIFRGSYLAGAGLAFSLIKNAQTPRRGTGTTGETLGEKWKRQLNSLDRKEFEEYKRSGILEVDRTEAKSALKDGSKIKHAVSRGSSKIRWIVERGMVKPKGKVVDLGCGRGGWSYYMATLKNVTEVKGYTKGGPGHEEPIPMATYGWNLVKLHSGVDVFYKPTEQVDTLLCDIGESSSNPTIEEGRTLRVLKMVEPWLSSKPEFCIKVLNPYMPTVIEELEKLQRKHGGNLVRCPLSRNSTHEMYWVSGASGNIVSSVNTTSKMLLNRFTTRHRKPTYEKDVDLGAGTRSVSTETEKPDMTIIGRRLQRLQEEHKETWHYDQENPYRTWAYHGSYEAPSTGSASSMVNGVVKLLTKPWDVIPMVTQLAMTDTTPFGQQRVFKEKVDTRTPQPKPGTRVVMTTTANWLWALLGKKKNPRLCTREEFISKVRSNAAIGAVFQEEQGWTSASEAVNDSRFWELVDKERALHQEGKCESCVYNMMGKREKKLGEFGRAKGSRAIWYMWLGARFLEFEALGFLNEDHWFGRENSWSGVEGEGLHRLGYILEEIDKKDGDLMYADDTAGWDTRITEDDLQNEELITEQMAPHHKILAKAIFKLTYQNKVVKVLRPTPRGAVMDIISRKDQRGSGQVGTYGLNTFTNMEVQLIRQMEAEGVITQDDMQNPKGLKERVEKWLRECGVDRLKRMAISGDDCVVKPLDERFGTSLLFLNDMGKVRKDIPQWEPSKGWKNWQEVPFCSHHFHKIFMKDGRSLVVPCRNQDELIGRARISQGAGWSLRETACLGKAYAQMWSLMYFHRRDLRLASMAICSAVPTEWFPTSRTTWSIHAHHQWMTTEDMLKVWNRVWIEDNPNMIDKTPVHSWEDIPYLGKREDLWCGSLIGLSSRATWAKNIHTAITQVRNLIGKEEYVDYMPVMKRYSAPSESEGVL

SEQ ID NO: 5169 - protein, 3288 aa, Artificial Sequence
  derived and/or modified protein sequence (wt) from DENV-4__EU854296__SS-prME
STITLLCLIPTVMAFHLSTRDGEPLMIVAKHERGRPLLFKTTEGINKCTLIAMDLGEMCEDTVTYKCPLLVNTEPEDIDCWCNLTSTWVMYGTCTQSGERRREKRSVALTPHSGMGLETRAETWMSSEGAWKHAQRVESWILRNPGFALLAGFMAYMIGQTGIQRTVFFVLMMLVAPSYGMRCVGVGNRDFVEGVSGGAWVDLVLEHGGCVTTMAQGKPTLDFELTKTTAKEVALLRTYCIEASISNITTATRCPTQGEPYLKEEQDQQYICRRDVVDRGWGNGCGLFGKGGVVTCAKFSCSGKITGNLVQIENLEYTVVVTVHNGDTHAVGNDTSNHGVTATITPRSPSVEVKLPDYGELTLDCEPRSGIDFNEMILMKMKKKTWLVHKQWFLDLPLPWTAGADTSEVHWNYKERMVTFKVPHAKRQDVTVLGSQEGAMHSALAGATEVDSGDGNHMFAGHLKCKVRMEKLRIKGMSYTMCSGKFSIDKEMAETQHGTTVVKVKYEGAGAPCKVPIEIRDVNKEKVVGRVISSTPLAENTNSVTNIELEPPFGDSYIVIGVGNSALTLHWFRKGSSIGKMFESTYRGAKRMAILGETAWDFGSVGGLFTSLGKAVHQVFGSVYTTMFGGVSWMIRILIGFLVLWIGTNSRNTSMAMTCIAVGGITLFLGFTVQADMGCVVSWSGRELKCGSGIFVVDNVHTWTEQYKFQPESPARLASAILNAHKDGVCGIRSTTRLENVMWKQITNELNYVLWEGGHDLTVVAGDAKGVLTKGKRALTPPVSDLKYSWKTWGKAKIFTPEARNSTFLIDGPDTSECPNERRAWNSLEVEDYGFGMFTTNIWMKFREGSSEVCDHRLMSAAIKDQKAVHADMGYWIESSKNQTWQIEKASLIEVKTCLWPKTHTLWSNGVLESQMLIPKSYAGPFSQHNYRQGYATQTVGPWHLGKLEIDFGECPGTTVTIQEDCDHRGPSLRTTTASGKLVTQWCCRSCTMPPLRFLGEDGCWYGMEIRPLSEKEENMVKSQVTAGQGTSETFSMGLLCLTLFVEECLRRRVTRKHMILAVVITLCAIILGGLTWMDLLRALIMLGDTMSGRIGGQTHLAIMAVFKMSPGYVLGVFLRKLTSRETALMVIGMAMTTTLSIPHDLMELIDGISLGLILLKIVTQFDNTQVGTLALSLTFIRSTMSLVMAWRTIMAVLFVVTLIPLCRTSCLQKQSHWVEITALILGAQALPVYLMTLMKGASRRSWPLNEGIMAVGLVSLLGSALLKNDVPLAGPMVAGGLLLAAYVMSGSSADLSLEKAANVQWDEMADITGSSPIIEVKQDEDGSFSIRDVEETNMITLLVKLALITVSGLYPLAIPVTMTLWYMWQVKTQRSGALWDVPSPAATQKAALSEGVYRIMQRGLFGKTQVGVGIHMEGVFHTMWHVTRGSVICHETGRLEPSWADVRNDMISYGGGWRLGDKWDKEEDVQVLAIEPGKNPKHVQTKPGLFKTLTGEIGAVTLDFKPGTSGSPIINRKGKVIGLYGNGVVTKSGDYVSAITQAERIGEPDYEVDEDIFRKKRLTIMDLHPGAGKTKRILPSIVREALKRRLRTLILAPTRVVAAEMEEALRGLPIRYQTPAVKSEHTGREIVDLMCHATFTTRLLSSTRVPNYNLIVMDEAHFTDPSSVAARGYISTRVEMGEAAAIFMTATPPGATDPFPQSNSPIEDIEREIPERSWNTGFDWITDYQGKTVWFVPSIKAGNDIANCLRKSGKKVIQLSRKTFDTEYPKTKLTDWDFVVTTDISEMGANFRAGRVIDPRRCLKPVILTDGPERVILAGPIPVTPASAAQRRGRIGRNPAQEDDQYVFSGDPLKNDEDHAHWTEAKMLLDNIYTPEGIIPTLFGPEREKTQAIDGEFRLRGEQRKTFVELMRRGDLPVWLSYKVASAGISYKDREWCFTGERNNQILEENMEVEIWTREGEKKKLRPRWLDARVYADPMALKDFKEFASGRKSITLDILTEIASLPTYLSSRAKLALDNIVMLHTTERGGRAYQHALNELPESLETLMLVALLGAMTAGIFLFFMQGKGIGKLSMGLITIAVASGLLWVAEIQPQWIAASIILEFFLMVLLIPEPEKQRTPQDNQLIYVILTILTIIGLIAANEMGLIEKTKTDFGFYQAKTETTILDVDLRPASAWTLYAVATTILTPMLRHTIENTSANLSLAAIANQAAVLMGLGKGWPLHRMDLGVPLLAMGCYSQVNPTTLTASLVMLLVHYAIIGPGLQAKATREAQKRTAAGIMKNPTVDGITVIDLEPISYDPKFEKQLGQVMLLVLCAGQLLLMRTTWAFCEVLTLATGPILTLWEGNPGRFWNTTIAVSTANIFRGSYLAGAGLAFSLIKNAQTPRRGTGTIGETLGEKWKRQLNSLDRKEFEEYKRSGILEVDRTEAKSALKDGSKIKHAVSRGSSKIRWIVERGMVKPKGKVVDLGCGRGGWSYYMATLKNVTEVKGYTKGGPGHEEPIPMATYGWNLVKLHSGVDVFYRPTEQVDTLLCDIGESSSNPTIEEGRTLRVLKMVEPWLSSKPEFCIKVLNPYMPTVIEELEKLQRKHGGNLVRCPLSRNSTHEMYWVSGASGNIVSSVNTTSKMLLNRFTTRHRKPTYEKDVDLGAGTRSVSTETEKPDMTIIGRRLQRLQEEHKETWHYDQENPYRTWAYHGSYEAPSTGSASSMVNGVVKLLTKPWDVIPMVTQLAMTDTTPFGQQRVFKEKVDTRTPQPKPGTRMVMTTTANWLWALLGKKKNPRLCTREEFISKVRSNAAIGAVFQEEQGWTSASEAVNDSRFWELVDKERALHQEGKCESCVYNMMGKREKKLGEFGRAKGSRAIWYMWLGARFLEFEALGFLNEDHWFGRENSWSGVEGEGLHRLGYILEEIDKKDGDLMYADDTAGWDTRITEDDLQNEELITEQMAPHHKILAKAIFKLTYQNKVVKVLRPTPRGAVMDIISRKDQRGSGQVGTYGLNTFTNMEVQLIRQMEAEGVITQDDMQNPKGLKERVEKWLRECGVDRLKRMAISGDDCVVKPLDERFGTSLLFLNDMGKVRKDIPQWEPSKGWKNWQEVPFCSHHFHKIFMKDGRSLVVPCRNQDELIGRARISQGAGWSLRETACLGKAYAQMWSLMYFHRRDLRLASMAICSAVPTEWFPTSRTTWSIHAHHQWMTTEDMLKVWNRVWIEDNPNMIDKTPVHSWEDIPYLGKREDLWCGSLIGLSSRATWAKNIHTAITQVRNLIGKEEYVDYMPVMKRYSAPSESEGVL

SEQ ID NO: 5170 - protein, 3288 aa, Artificial Sequence
  derived and/or modified protein sequence (wt) from DENV-4__GQ199878__SS-prME
STITLLCLIPTVMAFHLSTRDGEPLMIVAKHERGRPLLFKTTEGINKCTLIAMDLGEMCEDTVTYKCPLLVNTEPEDIDCWCNLTSTWVMYGTCTQSGERRREKRSVALTPHSGMGLETRAETWMSSEGAWKHAQRVESWILRNPGFALLAGFMAYMIGQTGIQRTVFFVLMMLVAPSYGMRCVGVGNRDFVEGVSGGAWVDLVLEHGGCVTTMAQGKPTLDFELTKTTAKEVALLRTYCIEASISNITTATRCPTQGEPYLKEEQDQQYICRRDVVDRGWGNGCGLFGKGGVVTCAKFSCSGKITGNLVQIENLEYTVVVTVHNGDTHAVGNDTSNHGVTATITPRSPSVEVKLPDYGELTLDCEPRSGIDFNEMILMKMKKKTWLVHKQWFLDLPLPWTAGADTSEVHWNYKERMVTFKVPHAKRQDVTVLGSQEGAMHSALAGATEVDSGDGNHMFAGHLKCKVRMEKLRIKGMSYTMCSGKFSIDKEMAETQHGTTVVKVKYEGAGAPCKVPIEIRDVNKEKVVGRVISSTPLAENTNSVTNIELEPPFGDSYIVIGVGNSALTLHWFRKGSSIGKMFESTYRGAKRMAILGETAWDFGSVGGLFTSLGKAVHQVFGSVYTTMFGGVSWMIRILIGFLVLWIGTNSRNTSMAMTCIAVGGITLFLGFTVQADMGCVVSWSGRELKCGSGIFVVDNVHTWTEQYKFQPESPARLASAILNAHKDGVCGIRSTTRLENVMWKQITNELNYVLWEGGHDLTVVAGDVKGVLTKGKRALTPPVSDLKYSWKTWGKAKIFTPEARNSTFLIDGPDTSECPNERRAWNSLEVEDYGFGMFTTNIWMKFREGSSEVCDHRLMSAAIKDQKAVHADMGYWIESSKNQTWQIEKASLIEVKTCLWPKTHTLWSNGVLESQMLIPKSYAGPFSQHNYRQGYATQTVGPWHLGKLEIDFGECPGTTVTIQEDCDHRGPSLRTTTASGKLVTQWCCRSCTMPPLRFLGEDGCWYGMEIRPLSEKEENMVKSQVAAGQGTSETFSMGLLCLTLFVEECLRRRVTRKHMILAVVITLCAIILGGLTWMDLLRALIMLGDTMSGRIGGQTHLAIMAVFKMSPGYVLGVFLRKLTSRETALMVIGMAMTTTLSIPHDLMELIDGISLGLILLKIVTQFDNTQVGTLALSLTFIRSTMSLVMAWRTIMAVLFVVTLIPLCRTSCLQKQSHWVEITALILGAQALPVYLMTLMKGASRRSWPLNEGIMAVGLVSLLGSALLKNDVPLAGPMVAGGLLLAAYVMSGSSADLSLEKAANVQWDEMADITGSSPIIEVKQDEDGSFSIRDVEETNMITLLVKLALITVSGLYPLAIPVTMTLWYMWQVKTQRSGALWDVPSPAATQKAALSEGVYRIMQRGLFGKTQVGVGIHMEGVFHTMWHVTRGSVICHETGRLEPSWADVRNDMISYGGGWRLGDKWDKEEDVQVLAIEPGKNPKHVQTKPGLFKTLTGEIGAVTLDFKPGTSGSPIINRKGKVIGLYGNGVVTKSGDYVSAITQAERIGEPDYEVDEDIFRKKRLTIMDLHPGAGKTKRILPSIVREALKRRLRTLILAPTRVVAAEMEEALRGLPIRYQTPAVKSEHTGREIVDLMCHATFTTRLLSSTRVPNYNLIVMDEAHFTDPSSVAARGYISTRVEMGEAAAIFMTATPPGATDPFPQSNSPIEDIEREIPERSWNTGFDWITDYQGKTVWFVPSIKAGNDIANCLRKSGKKVIQLSRKTFDTEYPKTKLTDWDFVVTTDISEMGANFRAGRVIDPRRCLKPVILTDGPERVILAGPIPVTPASAAQRRGRIGRNPAQEDDQYVFSGDPLKNDEDHAHWTEAKMLLDNIYTPEGIIPTLFGPEREKTQAIDGEFRLRGEQRKTFVELMRRGDLPVWLSYKVASAGISYKDREWCFTGERNNQILEENMEVEIWTREGEKKKLRPRWLDARVYADPMALKDFKEFASGRKSITLDILTEIASLPTYLSSRAKLALDNIVMLHTTERGGRAYQHALNELPESLETLMLVALLGAMTAGIFLFFMQGKGIGKLSMGLITIAVASGLLWVAEIQPQWIAASIILEFFLMVLLIPEPEKQRTPQDNQLIYVILTILTIIGLIAANEMGLIEKTKTDFGFYQVKTETTILDVDLRPASAWTLYAVATTILTPMLRHTIENTSANLSLAAIANQAAVLMGLGKGWPLHRMDLGVPLLAMGCYSQVNPTTLTASLVMLLVHYAIIGPGLQAKATREAQKRTAAGIMKNPTVDGITVIDLEPISYDPKFEKQLGQVMLLVLCAGQLLLMRTTWAFCEVLTLATGPILTLWEGNPGRFWNTTIAVSTANIFRGSYLAGAGLAFSLIKNAQTPRRGTGTTGETLGEKWKRQLNSLDRKEFEEYKRSGILEVDRTEAKSALKDGSKIKHAVSRGSSKIRWIVERGMVKPKGKVVDLGCGRGGWSYYMATLKNVTEVKGYTKGGPGHEEPIPMATYGWNLVKLHSGVDVFYKPTEQVDTLLCDIGESSSNPTIEEGRTLRVLKMVEPWLSSKPEFCIKVLNPYMPTVIEELEKLQRKHGGNLVRCPLSRNSTHEMYWVSGASGNIVSSVNTTSKMLLNRFTTRHRKPTYEKDVDLGAGTRSVSTETEKPDMTIIGRRLQRLQEEHKETWHYDQENPYRTWAYHGSYEAPSTGSASSMVNGVVKLLTKPWDVIPMVTQLAMTDTTPFGQQRVFKEKVDTRTPQPKPGTRMVMTTTANWLWALLGKKKNPRLCTREEFISKVRSNAAIGAVFQEEQGWTSASEAVNDSRFWELVDKERALHQEGKCESCVYNMMGKREKKLGEFGRAKGSRAIWYMWLGARFLEFEALGFLNEDHWFGRENSWSGVEGEGLHRLGYILEEIDKKDGDLMYADDTAGWDTRITEDDLQNEELITEQMAPHHKILAKAIFKLTYQNKVVKVLRPTPRGAVMDIISRKDQRGSGQVGTYGLNTFTNMEVQLIRQMEAEGVITQDDMQNPKGLKERVEKWLRECGVDRLKRMAISGDDCVVKPLDERFGTSLLFLNDMGKVRKDIPQWEPSKGWKNWQEVPFCSHHFHKIFMKDGRSLVVPCRNQDELIGRARISQGAGWSLRETACLGKAYAQMWSLMYFHRRDLRLASMAICSAVPTEWFPTSRTTWSIHAHHQWMTTEDMLKVWNRVWIEDNPNMIDKTPVHSWEDIPYLGKREDLWCGSLIGLSSRATWAKNIHTAITQVRNLIGKEEYVDYMPVMKRYSAPSESEGVL

SEQ ID NO: 5171 - protein, 3288 aa, Artificial Sequence
  derived and/or modified protein sequence (wt) from DENV-4__GQ199879__SS-prME
STITLLCLIPTVMAFHLSTRDGEPLMIVAKHERGRPLLFKTTEGINKCTLIAMDLGEMCEDTVTYKCPLLVNTEPEDIDCWCNLTSTWVMYGTCTQSGERRREKRSVALTPHSGMGLETRAETWMSSEGAWKHAQRVESWILRNPGFALLAGFMAYMIGQTGIQRTVFFVLMMLVAPSYGMRCVGVGNRDFVEGVSGGAWVDLVLEHGGCVTTMAQGKPTLDFELTKTTAKEVALLRTYCIEASISNITTATRCPTQGEPYLKEEQDQQYICRRDVVDRGWGNGCGLFGKGGVVTCAKFSCSGKITGNLVQIENLEYTVVVTVHNGDTHAVGNDTSNHGVTATITPRSPSVEVKLPDYGELTLDCEPRSGIDFNEMILMKMKKKTWLVHKQWFLDLPLPWTAGADTSEVHWNYKERMVTFKVPHAKRQDVTVLGSQEGAMHSALAGATEVDSGDGNHMFAGHLKCKVRMEKLRIKGMSYTMCSGKFSIDKEMAETQHGTTVVKVKYEGAGAPCKVPIEIRDVNKEKVVGRVISSTPLAENTNSVTNIELEPPFGDSYIVIGVGNSALTLHWFRKGSSIGKMFESTYRGAKRMAILGETAWDFGSVGGLFTSLGKAVHQVFGSVYTTMFGGVSWMVRILIGFLVLWIGTNSRNTSMAMTCIAVGGITLFLGFTVQADMGCVVSWSGRELKCGSGIFVVDNVHTWTEQYKFQPESPARLASAILNAHKDGVCGIRSTTRLENVMWKQITNELNYVLWEGGHDLTVVAGDVKGVLTKGKRALTPPVSDLKYSWKTWGKAKIFTPEARNSTFLIDGPDTSECPNERRAWNSLEVEDYGFGMFTTNIWMKFREGSSEVCDHRLMSAAIKDQKAVHADMGYWIESSKNQTWQIEKASLIEVKTCLWPKTHTLWSNGVLESQMLIPKSYAGPFSQHNYRQGYATQTVGPWHLGKLEIDFGECPGTTVTIQEDCDHRGPSLRTTTASGKLVTQWCCRSCTMPPLRFLGEDGCWYGMEIRPLNEKEENMVKSQVTAGQGTSETFSMGLLCLTLFVEECLRRRVTRKHMILVVVITLCAIILGGLTWMDLLRALIMLGDTMSGRIGGQIHLAIMAVFKMSPGYVLGVFLRKLTSRETALMVIGMAMTTVLSIPHDLMELIDGISLGLILLKIVTQFDNTQVGTLALSLTFIRSTMPLVMAWRTIMAVLFVVTLIPLCRTSCLQKQSHWVEITALILGAQALPVYLMTLMKGASRRSWPLNEGIMAVGLVSLLGSALLKNDVPLAGPMVAGGLLLAAYVMSGSSADLSLEKAANVQWDEMADITGSSPIIEVKQDEDGSFSIRDVEETNMITLLVKLALITVSGLYPLAIPVTMTLWYMWQVKTQRSGALWDVPSPAATQKAALSEGVYRIMQRGLFGKTQVGVGIHMEGVFHTMWHVTRGSVICHETGRLEPSWADVRNDMISYGGGWRLGDKWDKEEDVQVLAIEPGKNPKHVQTKPGLFKTLTGEIGAVTLDFKPGTSGSPIINRKGKVIGLYGNGVVTKSGDYVSAITQAERIGEPDYEVDEDIFRKKRLTIMDLHPGAGKTKRILPSIVREALKRRLRTLILAPTRVVAAEMEEALRGLPIRYQTPAVKSEHTGREIVDLMCHATFTTRLLSSTRVPNYNLIVMDEAHFTDPSSVAARGYISTRVEMGEAAAIFMTATPPGATDPFPQSNSPIEDIEREIPERSWNTGFDWITDYQGKTVWFVPSIKAGNDIANCLRKSGKKVIQLSRKTFDTEYPKTKLTDWDFVVTTDISEMGANFRAGRVIDPRRCLKPVILTDGPERVILAGPIPVTPASAAQRRGRIGRNPAQEDDQYVFSGDPLKNDEDHAHWTEAKMLLDNIYTPEGIIPTLFGPEREKTQAIDGEFRLRGEQRKTFVELMRRGDLPVWLSYKVASAGISYKDREWCFTGERNNQILEENMEVEIWTREGEKKKLRPRWLDARVYADPMALKDFKEFASGRKSITLDILTEIASLPTYLSSRAKLALDNIVMLHTTERGGRAYQHALNELPESLETLMLVALLGAMTAGIFLFFMQGKGIGKLSMGLIAIAVASGLLWVAEIQPQWIAASIILEFFLMVLLIPEPEKQRTPQDNQLIYVILTILTIIGLIAANEMGLIEKTKTDFGFYQVKTETTILDVDLRPASAWTLYAVATTILTPMLRHTIENTSANLSLAAIANQAAVLMGLGKGWPLHRMDLGVPLLAMGCYSQVNPTTLTASLVMLLVHYAIIGPGLQAKATREAQKRTAAGIMKNPTVDGITVIDLEPISYDPKFEKQLGQVMLLVLCAGQLLLMRTTWAFCEVLTLATGPILTLWEGNPGRFWNTTIAVSTANIFRGSYLAGAGLAFSLIKNAQTPRRGTGTTGETLGEKWKRQLNSLDRKEFEEYKRSGILEVDRTEAKSALKDGSKTKHAVSRGSSKIRWIVERGMVKPKGKVVDLGCGRGGWSYYMATLKNVTEVKGYTKGGPGHEEPIPMATYGWNLVKLHSGVDVFYKPTEQVDTLLCDIGESSSNPTIEEGRTLRVLKMVEPWLSSKPEFCIKVLNPYMPTVIEELEKLQRKHGGNLVRCPLSRNSTHEMYWVSGASGNIVSSVNTTSKMLLNRFTTRHRKPTYEKDVDLGAGTRSVSTETEKPDMTIIGRRLQRLQEEHKETWHYDQENPYRTWAYHGSYEAPSTGSASSMVNGVVKLLTKPWDVIPMVTQLAMTDTTPFGQQRVFKEKVDTRTPQPKPGTRMIMTTTANWLWALLGKKKNPRLCTREEFISKVRSNAAIGAVFQEEQGWTSASEAVNDSRFWELVDKERALHQEGKCESCVYNMMGKREKKLGEFGRAKGSRAIWYMWLGARFLEFEALGFLNEDHWFGRENSWSGVEGEGLHRLGYILEEIDKKDGDLMYADDTAGWDTRITEDDLQNEELITEQMAPHHKILAKAIFKLTYQNKVVKVLRPTPRGAVMDIISRKDQRGSGQVGTYGLNTFTNMEVQLIRQMEAEGVITQDDMQNPKGLKERVEKWLRECGVDRLKRMAISGDDCVVKPLDERFGTSLLFLNDMGKVRKDIPQWEPSKGWKNWQEVPFCSHHFHKIFMKDGRSLVVPCRNQDELIGRARISQGAGWSLRETACLGKAYAQMWSLMYFHRRDLRLASMAICSAVPTEWFPTSRTTWSIHAHHQWMTTEDMLKVWNRVWIEDNPNMTDKTPIHSWEDIPYLGKREDLWCGSLIGLSSRATWAKNIHTAITQVRNLIGKEEYVDYMPVMKRYSAPSESEGVL

SEQ ID NO: 5172 - protein, 3288 aa, Artificial Sequence
  derived and/or modified protein sequence (wt) from DENV-4__GQ199880__SS-prME
STITLLCLIPTVMAFHLSTRDGEPLMIVAKHERGRPLLFKTTEGINKCTLIAMDLGEMCEDTVTYKCPLLVNTEPEDIDCWCNLTSTWVMYGTCTQSGERRREKRSVALTPHSGMGLETRAETWMSSEGAWKHAQRVESWILRNPGFALLAGFMAYMIGQTGIQRTVFFVLMMLVAPSYGMRCVGVGNRDFVEGVSGGAWVDLVLEHGGCVTTMAQGKPTLDFELTKTTAKEVALLRTYCIEASISNITTATRCPTQGEPYLKEEQDQQYICRRDVVDRGWGNGCGLFGKGGVVTCAKFSCSGKITGNLVQIENLEYTVVVTVHNGDTHAVGNDTSNHGVTATITPRSPSVEVKLPDYGELTLDCEPRSGIDFNEMILMKMKKKTWLVHKQWFLDLPLPWTAGADTSEVHWNYKERMVTFKVPHAKRQDVTVLGSQEGAMHSALAGATEVDSGDGNHMFAGHLKCKVRMEKLRIKGMSYTMCSGKFSIDKEMAETQHGTTVVKVKYEGAGAPCKVPIEIRDVNKEKVVGRVISSTPLAENTNSVTNIELEPPFGDSYIVIGVGNSALTLHWFRKGSSIGKMFESTYRGAKRMAILGETAWDFGSVGGLFTSLGKAVHQVFGSVYTTMFGGVSWMIRILIGFLVLWIGTNSRNTSMAMTCIAVGGITLFLGFTVQADMGCVVSWSGRELKCGSGIFVVDNVHTWTEQYKFQPESPARLASAILNAHKDGVCGIRSTTRLENVMWKQITNELNYVLWEGGHDLTVVAGDVKGVLTKGKRALTPPVSDLKYSWKTWGKAKIFTPEARNSTFLIDGPDTSECPNERRAWNSLEVEDYGFGMFTTNIWMKFREGSSEVCDHRLMSAAIKDQKAVHADMGYWIESSKNQTWQIEKASLIEVKTCLWPKTHTLWSNGVLESQMLIPKSYAGPFSQHNYRQGYATQTVGPWHLGKLEIDFGECPGTTVTIQEDCDHRGPSLRTTTASGKLVTQWCCRSCTMPPLRFLGEDGCWYGMEIRPLNEKEENMVKSQVTAGQGTSETFSMGLLCLTLFVEECLRRRVTRKHMILVVVITLCAIILGGLTWMDLLRALIMLGDTMSGRIGGQIHLAIMAVFKMSPGYVLGVFLRKLTSRETALMVIGMAMTTVLSIPHDLMELIDGISLGLILLKIVTQFDNTQVGTLALSLTFIRSTMPLVMAWRTIMAVLFVVTLIPLCRTSCLQKQSHWVEITALILGAQALPVYLMTLMKGASRRSWPLNEGIMAVGLVSLLGSALLKNDVPLAGPMVAGGLLLAAYVMSGSSADLSLEKAANVQWDEMADITGSSPIIEVKQDEDGSFSIRDVEETNMITLLVKLALITVSGLYPLAIPVTMTLWYMWQVKTQRSGALWDVPSPAATQKAALSEGVYRIMQRGLFGKTQVGVGIHMEGVFHTMWHVTRGSVICHETGRLEPSWADVRNDMISYGGGWRLGDKWDKEEDVQVLAIEPGKNPKHVQTKPGLFKTLTGEIGAVTLDFKPGTSGSPIINRKGKVIGLYGNGVVTKSGDYVSAITQAERIGEPDYEVDEDIFRKKRLTIMDLHPGAGKTKRILPSIVREALKRRLRTLILAPTRVVAAEMEEALRGLPIRYQTPAVKSEHTGREIVDLMCHATFTTRLLSSTRVPNYNLIVMDEAHFTDPSSVAARGYISTRVEMGEAAAIFMTATPPGATDPFPQSNSPIEDIEREIPERSWNTGFDWITDYQGKTVWFVPSIKAGNDIANCLRKSGKKVIQLSRKTFDTEYPKTKLTDWDFVVTTDISEMGANFRAGRVIDPRRCLKPVILTDGPERVILAGPIPVTPASAAQRRGRIGRNPAQEDDQYVFSGDPLKNDEDHAHWTEAKMLLDNIYTPEGIIPTLFGPEREKTQAIDGEFRLRGEQRKTFVELMRRGDLPVWLSYKVASAGISYKDREWCFTGERNNQILEENMEVEIWTREGEKKKLRPRWLDARVYADPMALKDFKEFASGRKSITLDILTEIASLPTYLSSRAKLALDNIVMLHTTERGGRAYQHALNELPESLETLMLVALLGAMTAGIFLFFMQGKGIGKLSMGLIAIAVASGLLWVAEIQPQWIAASIILEFFLMVLLIPEPEKQRTPQDNQLIYVILTILTIIGLIAANEMGLIEKTKTDFGFYQVKTETTILDVDLRPASAWTLYAVATTILTPMLRHTIENTSANLSLAAIANQAAVLMGLGKGWPLHRMDLGVPLLAMGCYSQVNPTTLTASLVMLLVHYAIIGPGLQAKATREAQKRTAAGIMKNPTVDGITVIDLEPISYDPKFEKQLGQVMLLVLCAGQLLLMRTTWAFCEVLTLATGPILTLWEGNPGRFWNTTIAVSTANIFRGSYLAGAGLAFSLIKNAQTPRRGTGTTGETLGEKWKRQLNSLDRKEFEEYKRSGILEVDRTEAKSALKDGSKTKHAVSRGSSKIRWIVERGMVKPKGKVVDLGCGRGGWSYYMATLKNVTEVKGYTKGGPGHEEPIPMATYGWNLVKLHSGVDVFYKPTEQVDTLLCDIGESSSNPTIEEGRTLRVLKMVEPWLSSKPEFCIKVLNPYMPTVIEELEKLQRKHGGNLVRCPLSRNSTHEMYWVSGASGNIVSSVNTTSKMLLNRFTTRHRKPTYEKDVDLGAGTRSVSTETEKPDMTIIGRRLQRLQEEHKETWHYDQENPYRTWAYHGSYEAPSTGSASSMVNGVVKLLTKPWDVIPMVTQLAMTDTTPFGQQRVFKEKVDTRTPQPKPGTRMIMTTTANWLWALLGKKKNPRLCTREEFISKVRSNAAIGAVFQEEQGWTSASEAVNDSRFWELVDKERALHQEGKCESCVYNMMGKREKKLGEFGRAKGSRAIWYMWLGARFLEFEALGFLNEDHWFGRENSWSGVEGEGLHRLGYILEEIDKKDGDLMYADDTAGWDTRITEDDLQNEELITEQMAPHHKILAKAIFKLTYQNKVVKVLRPTPRGAVMDIISRKDQRGSGQVGTYGLNTFTNMEVQLIRQMEAEGVITQDDMQNPKGLKERVEKWLRECGVDRLKRMAISGDDCVVKPLDERFGTSLLFLNDMGKVRKDIPQWEPSKGWKNWQEVPFCSHHFHKIFMKDGRSLVVPCRNQDELIGRARISQGAGWSLRETACLGKAYAQMWSLMYFHRRDLRLASMAICSAVPTEWFPTSRTTWSIHAHHQWMTTEDMLKVWNRVWIEDNPNMTDKTPIHSWEDIPYLGKREDLWCGSLIGLSSRATWAKNIHTAITQVRNLIGKEEYVDYMPVMKRYSAPSESEGVL

SEQ ID NO: 5173 - protein, 3288 aa, Artificial Sequence
  derived and/or modified protein sequence (wt) from DENV-4__GQ252675__SS-prME
STITLLCLIPTVMAFHLSTRDGEPLMIVAKHERGRPLLFKTTEGINKCTLIAMDLGEMCEDTVTYKCPLLVNTEPEDIDCWCNLTSTWVMYGTCTQSGERRREKRSVALTPHSGMGLETRAETWMSSEGAWKHAQRVESWILRNPGFALLAGFMAYMIGQTGIQRTVFFVLMMLVAPSYGMRCVGVGNRDFVEGVSGGAWVDLVLEHGGCVTTMAQGKPTLDFELTKTTAKEVALLRTYCIEASISNITTATRCPTQGEPYLKEEQDQQYICRRDVVDRGWGNGCGLFGKGGVVTCAKFSCSGKITGNLVQIENLEYTVVVTVHNGDTHAVGNDTSNHGVTATITPRSPSVEVKLPDYGELTLDCEPRSGIDFNEMILMKMKKKTWLVHKQWFLDLPLPWTAGADTSEVHWNYKERMVTFKVPHAKRQDVTVLGSQEGAMHSALAGATEVDSGDGNHMFAGHLKCKIRMEKLRIKGMSYTMCSGKFSIDKEMAETQHGTTVVKVKYEGAGAPCKVPIEIRDVNKEKVVGRVISSTPLAENTNSVTNIELEPPFGDSYIVIGVGNSALTLHWFRKGSSIGKMFESTYRGAKRMAILGETAWDFGSVGGLFTSLGKAVHQVFGSVYTTMFGGVSWMIRILIGFLVLWIGTNSRNTSMAMTCIAVGGITLFLGFTVQADMGCVVSWSGRELKCGSGIFVVDNVHTWTEQYKFQPESPARLASAILNAHKDGVCGIRSTTRLENVMWKQITNELNYVLWEGGHDLTVVAGDVKGVLTKGKRALTPPVSDLKYSWKTWGKAKIFTPEARNSTFLIDGPDTSECPNERRAWNSLEVEDYGFGMFTTNIWMKFREGSSEVCDHRLMSAAIKDQKAVHADMGYWIESSKNQTWQIEKASLIEVKTCLWPKTHTLWSNGVLESQMLIPKSYAGPFSQHNYRQGYATQTVGPWHLGKLEIDFGECPGTTVTIQEDCDHRGPSLRTTTASGKLVTQWCCRSCTMPPLRFLGEDGCWYGMEIRPLNEKEENMVKSQVTAGQGTSETFSMGLLCLTLFVEECLRRRVTRKHMMLVVVITLCAIILGGLTWMDLLRALIMLGDTMSGRIGGQIHLAIMAVFKMSPGYVLGVFLRKLTSRETALMVIGMAMTTVLSIPHDLMELIDGISLGLILLKTVTQFDNTQVGTLALSLTFIRSTMPLVMAWRTIMAVLFVVTLIPLCRTSCLQKQSHWVEITALILGAQALPVYLMTLMKGASRRSWPLNEGIMAVGLVSLLGSALLKNDVPLAGPMVAGGLLLAAYVMSGSSADLSLEKAANVQWDEMADITGSSPIIEVKQDEDGSFSIRDVEETNMITLLVKLALITVSGLYPLAIPVTMTLWYMWQVKTQRSGALWDVPSPAATQKAALSEGVYRIMQRGLFGKTQVGVGIHMEGVFHTMWHVTRGSVICHETGRLEPSWADVRNDMISYGGGWRLGDKWDKEEDVQVLAIEPGKNPKHVQTKPGLFKTLTGEIGAVTLDFKPGTSGSPIINKKGKVIGLYGNGVVTKSGDYVSAITQAERIGEPDYEVDEDIFRKKRLTIMDLHPGAGKTKRILPSIVREALKRRLRTLILAPTRVVAAEMEEALRGLPIRYQTPAVKSEHTGREIVDLMCHATFTTRLLSSTRVPNYNLIVMDEAHFTDPSSVAARGYISTRVEMGEAAAIFMTATPPGATDPFPQSNSPIEDIEREIPERSWNTGFDWITDYQGKTVWFVPSIKAGNDIANCLRKSGKKVIQLSRKTFDTEYPKTKLTDWDFVVTTDISEMGANFRAGRVIDPRRCLKPVILTDGPERVILAGPIPVTPASAAQRRGRIGRNPAQEDDQYVFSGDPLKNDEDHAHWTEAKMLLDNIYTPEGIIPTLFGPEREKTQAIDGEFRLRGEQRKTFVELMRRGDLPVWLSYKVASAGISYKDREWCFTGERNNQILEENMEVEIWTREGEKKKLRPRWLDARVYADPMALKDFKEFASGRKSITLDILTEIASLPTYLSSRAKLALDNIVMLHTTERGGRAYQHALNELPESLETLMLVALLGAMTAGIFLFFMQGKGIGKLSMGLIAIAVASGLLWVAEIQPQWIAASIILEFFLMVLLIPEPEKQRTPQDNQLIYVILTILTIIGLIAANEMGLIEKTKTDFGFYQVKTETTILDVDLRPASAWTLYAVATTILTPMLRHTIENTSANLSLAAIANQAAVLMGLGKGWPLHRMDLGVPLLAMGCYSQVNPTTLTASLVMLLVHYAIIGPGLQAKATREAQKRTAAGIMKNPTVDGITVIDLEPISYDPKFEKQLGQVMLLVLCAGQLLLMRTTWAFCEVLTLATGPILTLWEGNPGRFWNTTIAVSTANIFRGSYLAGAGLAFSLIKNAQTPRRGTGTTGETLGEKWKRQLNSLDRKEFEEYKRSGILEVDRTEAKSALKDGSKTKHAVSRGSSKIRWIVERGMVKPKGKVVDLGCGRGGWSYYMATLKNVTEVKGYTKGGPGHEEPIPMATYGWNLVKLHSGVDVFYKPTEQVDTLLCDIGESSSNPTIEEGRTLRVLKMVEPWLSSKPEFCIKVLNPYMPTVIEELEKLQRKHGGNLVRCPLSRNSTHEMYWVSGASGNIVSSVNTTSKMLLNRFTTRHRKPTYEKDVDLGAGTRSVSTETEKPDMTIIGRRLQRLQEEHKETWHYDQENPYRTWAYHGSYEAPSTGSASSMVNGVVKLLTKPWDVIPMVTQLAMTDTTPFGQQRVFKEKVDTRTPQPKPGTRMIMTTTANWLWALLGKKKNPRLCTREEFISKVRSNAAIGAVFQEEQGWTSASEAVNDSRFWELVDKERALHQEGKCESCVYNMMGKREKKLGEFGRAKGSRAIWYMWLGARFLEFEALGFLNEDHWFGRENSWSGVEGEGLHRLGYILEEIDKKDGDLMYADDTAGWDTRITEDDLQNEELITEQMAPHHKILAKAIFKLTYQNKVVKVLRPTPRGAVMDIISRKDQRGSGQVGTYGLNTFTNMEVQLIRQMEAEGVITQDDMQNPKGLKERVEKWLRECGVDRLKRMAISGDDCVVKPLDERFGTSLLFLNDMGKVRKDIPQWEPSKGWKNWQEVPFCSHHFHKIFMKDGRSLVVPCRNQDELIGRARISQGAGWSLRETACLGKAYAQMWSLMYFHRRDLRLASMAICSAVPTEWFPTSRTTWSIHAHHQWMTTEDMLKVWNRVWIEDNPNMTDKTPIHSWEDIPYLGKREDLWCGSLIGLSSRATWAKNIHTAITQVRNLIGKEEYVDYMPVMKRYSAPSESEGVL

SEQ ID NO: 5174 - protein, 3288 aa, Artificial Sequence
  derived and/or modified protein sequence (wt) from DENV-4__FJ810417__SS-prME
STITLLCLIPTVMAFHLSTRDGEPLMIVAKHERGRPLLFKTTEGINKCTLIAMDLGEMCEDTVTYKCPLLVNTEPEDIDCWCNLTSTWVMYGTCTQSGERRREKRSVALTPHSGMGLETRAETWMSSEGAWKHAQRVESWILRNPGFALLAGFMAYMIGQTGIQRTVFFVLMMLVAPSYGMRCVGVGNRDFVEGVSGGAWVDLVLEHGGCVTTMAQGKPTLDFELTKTTAKEVALLRTYCIEASISNITTATRCPTQGEPYLKEEQDQQYICRRDVVDRGWGNGCGLFGKGGVVTCAKFSCSGKITGNLVQIENLEYTVVVTVHNGDTHAVGNDTSNHGVTATITPRSPSVEVKLPDYGELTLDCEPRSGIDFNEMILMKMKKKTWLVHKQWFLDLPLPWTAGADTSEVHWNYKERMVTFKVPHAKRQDVTVLGSQEGAMHSALAGATEVDSGDGNHMFAGHLKCKVRMEKLRIKGMSYTMCSGKFSIDKEMAETQHGTTVVKVKYEGAGAPCKVPIEIRDVNKEKVVGRVISSIPLAENTNSVTNIELEPPFGDSYIVIGVGNSALTLHWFRKGSSIGKMFESTYRGAKRMAILGETAWDFGSVGGLFTSLGKAVHQVFGSVYTTMFGGVSWMIRILIGFLVLWIGTNSRNTSMAMTCIAVGGITLFLGFTVQADMGCVVSWSGRELKCGSGIFVVDNVHTWTEQYKFQPESPARLASAILNAHKDGVCGIRSTTRLENVMWKQITNELNYVLWEGGHDLTVVAGDVKGVLTKGKRALTPPVSDLKYSWKTWGKAKIFTPEARNSTFLIDGPDTSECPNERRAWNSLEVEDYGFGMFTTNIWMKFREGSSEVCDHRLMSAAIKDQKAVHADMGYWIESSKNQTWQIEKASLIEVKTCLWPKTHTLWSNGVLESQMLIPKSYAGPFSQHNYRQGYATQTVGPWHLGKLEIDFGECPGTTVTIQEDCDHRGPSLRTTTASGKLVTQWCCRSCTMPPLRFLGEDGCWYGMEIRPLNEKEENMVKSQVTAGQGTSETFSMGLLCLTLFVEECLRRRVTRKHMILVVVITLCAIILGGLTWMDLLRALIMLGDTMSGRIGGQIHLAIMAVFKMSPGYVLGVFLRKLTSRETALMVIGMAMTTVLSIPHDLMELIDGISLGLILLKIVTQFDNTQVGTLALSLTFIRSTMPLVMAWRTIMAVLFVVTLIPLCRTSCLQKQSHWVEITALILGAQALPVYLMTLMKGASRRSWPLNEGIMAVGLVSLLGSALLKNDVPLAGPMVAGGLLLAAYVMSGSSADLSLEKAANVQWDEMADITGSSPIIEVKQDEDGSFSIRDVEETNMITLLVKLALITVSGLYPLAIPVTMTLWYMWQVKTQRSGALWDVPSPAATQKAALSEGVYRIMQRGLFGKTQVGVGIHMEGVFHTMWHVTRGSVICHETGRLEPSWADVRNDMISYGGGWRLGDKWDKEEDVQVLAIEPGKNPKHVQTKPGLFKTLTGEIGAVTLDFKPGTSGSPIINRKGKVIGLYGNGVVTKSGDYVSAITQAERIGEPDYEVDEDIFRKKRLTIMDLHPGAGKTKRILPSIVREALKRRLRTLILAPTRVVAAEMEEALRGLPIRYQTPAVKSEHTGREIVDLMCHATFTTRLLSSTRVPNYNLIVMDEAHFTDPSSVAARGYISTRVEMGEAAAIFMTATPPGATDPFPQSNSPIEDIEREIPERSWNTGFDWITDYQGKTVWFVPSIKAGNDIANCLRKSGKKVIQLSRKTFDTEYPKTKLTDWDFVVTTDISEMGANFRAGRVIDPRRCLKPVILTDGPERVILAGPIPVTPASAAQRRGRIGRNPAQEDDQYVFSGDPLKNDEDHAHWTEAKMLLDNIYTPEGIIPTLFGPEREKTQAIDGEFRLRGEQRKTFVELMRRGDLPVWLSYKVASAGISYKDREWCFTGERNNQILEENMEVEIWTREGEKKKLRPRWLDARVYADPMALKDFKEFASGRKSITLDILTEIASLPTYLSSRAKLALDNIVMLHTTERGGRAYQHALNELPESLETLMLVALLGAMTAGIFLFFMQGKGIGKLSMGLIAIAVASGLLWVAEIQPQWIAASIILEFFLMVLLIPEPEKQRTPQDNQLIYVILTILTIIGLIAANEMGLIEKTKTDFGFYQVKTETTILDVDLRPASAWTLYAVATTILTPMLRHTIENTSANLSLAAIANQAAVLMGLGKGWPLHRMDLGVPLLAMGCYSQVNPTTLTASLVMLLVHYAIIGPGLQAKATREAQKRTAAGIMKNPTVDGITVIDLEPISYDPKFEKQLGQVMLLVLCAGQLLLMRTTWAFCEVLTLATGPILTLWEGNPGRFWNTTIAVSTANIFRGSYLAGAGLAFSLIKNAQTPRRGTGTTGETLGEKWKRQLNSLDRKEFEEYKRSGILEVDRTEAKSALKDGSKTKHAVSRGSSKIRWIVERGMVKPKGKVVDLGCGRGGWSYYMATLKNVTEVKGYTKGGPGHEEPIPMATYGWNLVKLHSGVDVFYKPTEQVDTLLCDIGESSSNPTIEEGRTLRVLKMVEPWLSSKPEFCIKVLNPYMPTVIEELEKLQRKHGGNLVRCPLSRNSTHEMYWVSGASGNIVSSVNTTSKMLLNRFTTRHRKPTYEKDVDLGAGTRSVSTETEKPDMTIIGRRLQRLQEEHKETWHYDQENPYRTWAYHGSYEAPSTGSASSMVNGVVKLLTKPWDVIPMVTQLAMTDTTPFGQQRVFKEKVDTRTPQPKPGTRMIMTTTANWLWALLGKKKNPRLCTREEFISKVRSNAAIGAVFQEEQGWTSASEAVNDSRFWELVDKERALHQEGKCESCVYNMMGKREKKLGEFGRAKGSRAIWYMWLGARFLEFEALGFLNEDHWFGRENSWSGVEGEGLHRLGYILEEIDKKDGDLMYADDTAGWDTRITEDDLQNEELITEQMAPHHKILAKAIFKLTYQNKVVKVLRPTPRGAVMDIISRKDQRGSGQVGTYGLNTFTNMEVQLIRQMEAEGVITQDDMQNPKGLKERVEKWLRECGVDRLKRMAISGDDCVVKPLDERFGTSLLFLNDMGKVRKDIPQWEPSKGWKNWQEVPFCSHHFHKIFMKDGRSLVVPCRNQDELIGRARISQGAGWSLRETACLGKAYAQMWSLMYFHRRDLRLASMAICSAVPTEWFPTSRTTWSIHAHHQWMTTEDMLKVWNRVWIEDNPNMTDKTPIHSWEDIPYLGKREDLWCGSLIGLSSRATWAKNIHTAITQVRNLIGKEEYVDYMPVMKRYSAPSESEGVL

SEQ ID NO: 5175 - protein, 3288 aa, Artificial Sequence
  derived and/or modified protein sequence (wt) from DENV-4__FJ850057__SS-prME
STITLLCLIPTAMAFHLSTRDGEPLMIVAKHERGRPLLFKTTEGINKCTLIAMDLGEMCEDTVTYKCPLLVNTEPEDIDCWCNLTSTWVMYGTCTQSGERRREKRSVALTPHSGMGLETRAETWMSSEGAWKHAQRVESWILRNPGFALLAGFMAYMIGQTGIQRTVFFVLMMLVAPSYGMRCVGVGNRDFVEGVSGGAWVDLVLEHGGCVTTMAQGKPTLDFELTKTTAKEVALLRTYCIEASISNITTATRCPTQGEPYLKEEQDQQYICRRDVVDRGWGNGCGLFGKGGVVTCAKFSCSGKITGNLVQIENLEYTVVVTVHNGDTHAVGNDTSNHGVTATITPRSPSVEVKLPDYGELTLDCEPRSGIDFNEMILMKMKKKTWLVHKQWFLDLPLPWTAGADTSEVHWNYKERMVTFKVPHAKRQDVTVLGSQEGAMHSALAGATEVDSGDGNHMFAGHLKCKVRMEKLRIKGMSYTMCSGKFSIDKEMAETQHGTTVVKVKYEGAGAPCKVPIEIRDVNKEKVVGRVISSTPLAENTNSVTNIELEPPFGDSYIVIGVGNSALTLHWFRKGSSIGKMFESTYRGAKRMAILGETAWDFGSVGGLFTSLGKAVHQVFGSVYTTMFGGVSWMIRILIGFLVLWIGTNSRNTSMAMTCIAVGGITLFLGFTVQADMGCVVSWSGRELKCGSGIFVVDNVHTWTEQYKFQPESPARLASAILNAHKDGVCGIRSTTRLENVMWKQITNELNYVLWEGGHDLTVVAGDVKGVLTKGKRALTPPVSDLKYSWKTWGKAKIFTPEARNSTFLIDGPDTSECPNERRAWNSLEVEDYGFGMFTTNIWMKFREGSSEVCDHRLMSAAIKDQKAVHADMGYWIESSKNQTWQIEKASLIEVKTCLWPKTHTLWSNGVLESQMLIPKSYAGPFSQHNYRQGYATQTVGPWHLGKLEIDFGECPGTTVTIQEDCDHRGPSLRTTTASGKLVTQWCCRSCTMPPLRFLGEDGCWYGMEIRPLNEKEENMVKSQVTAGQGTSETFSMGLLCLTLFVEECLRRRVTRKHMILVVVITLCAIILGGLTWMDLLRALIMLGDTMSGRIGGQIHLAIMAVFKMSPGYVLGVFLRKLTSRETALMVIGMAMTTVLSIPHDLMELIDGISLGLILLKIVTQFDNTQVGTLALSLTFIRSTMPLVMAWRTIMAVLFVVTLIPLCRTSCLQKQSHWVEITALILGAQALPVYLMTLMKGASRRSWPLNEGIMAVGLVSLLGSALLKNDVPLAGPMVAGGLLLAAYVMSGSSADLSLEKAANVQWDEMADITGSSPIIEVKQDEDGSFSIRDVEETNMITLLVKLALITVSGLYPLAIPVTMTLWYMWQVKTQRSGALWDVPSPAATQKAALSEGVYRIMQRGLFGKTQVGVGIHMEGVFHTMWHVTRGSVICHETGRLEPSWADVRNDMISYGGGWRLGDKWDKEEDVQVLAIEPGKNPKHVQTKPGLFKTLTGEIGAVTLDFKPGTSGSPIINRKGKVIGLYGNGVVTKSGDYVSAITQAERIGEPDYEVDEDIFRKKRLTIMDLHPGAGKTKRILPSIVREALKRRLRTLILAPTRVVAAEMEEALRGLPIRYQTPAVKSEHTGREIVDLMCHATFTTRLLSSTRVPNYNLIVMDEAHFTDPSSVAARGYISTRVEMGEAAAIFMTATPPGATDPFPQSNSPIEDIEREIPERSWNTGFDWITDYQGKTVWFVPSIKAGNDIANCLRKSGKKVIQLSRKTFDTEYPKTKLTDWDFVVTTDISEMGANFRAGRVIDPRRCLKPVILTDGPERVILAGPIPVTPASAAQRRGRIGRNPAQEDDQYVFSGDPLKNDEDHAHWTEAKMLLDNIYTPEGIIPTLFGPEREKTQAIDGEFRLRGEQRKTFVELMRRGDLPVWLSYKVASAGISYKDREWCFTGERNNQILEENMEVEIWTREGEKKKLRPRWLDARVYADPMALKDFKEFASGRKSITLDILTEIASLPTYLSSRAKLALDNIVMLHTTERGGRAYQHALNELPESLETLMLVALLGAMTAGIFLFFMQGKGIGKLSMGLIAIAVASGLLWVAEIQPQWIAASIILEFFLMVLLIPEPEKQRTPQDNQLIYVILTILTIIGLIAANEMGLIEKTKTDFGFYQVKTETTILDVDLRPASAWTLYAVATTILTPMLRHTIENTSANLSLAAIANQAAVLMGLGKGWPLHRMDLGVPLLAMGCYSQVNPTTLTASLVMLLVHYAIIGPGLQAKATREAQKRTAAGIMKNPTVDGITVIDLEPISYDPKFEKQLGQVMLLVLCAGQLLLMRTTWAFCEVLTLATGPTLTLWEGNPGRFWNTTIAVSTANIFRGSYLAGAGLAFSLIKNAQTPRRGTGTTGETLGEKWKRQLNSLDRKEFEEYKRSGILEVDRTEAKSALKDGSKTKHAVSRGSSKIRWIVERGMVKPKGKVVDLGCGRGGWSYYMATLKNVTEVKGYTKGGPGHEEPIPMATYGWNLVKLHSGVDVFYKPTEQVDTLLCDIGESSSNPTIEEGRTLRVLKMVEPWLSSKPEFCIKVLNPYMPTVIEELEKLQRKHGGNLVRCPLSRNSTHEMYWVSGASGNIVSSVNTTSKMLLNRFTTRHRKPTYEKDVDLGAGTRSVSTETEKPDMTIIGRRLQRLQEEHKETWHYDQENPYRTWAYHGSYEAPSTGSASSMVNGVVKLLTKPWDVIPMVTQLAMTDTTPFGQQRVFKEKVDTRTPQPKPGTRMIMTTTANWLWALLGKKKNPRLCTREEFISKVRSNAAIGAVFQEEQGWTSASEAVNDSRFWELVDKERALHQEGKCESCVYNMMGKREKKLGEFGRAKGSRAIWYMWLGARFLEFEALGFLNEDHWFGRENSWSGVEGEGLHRLGYILEEIDKKDGDLMYADDTAGWDTRITEDDLQNEELITEQMAPHHKILAKAIFKLTYQNKVVKVLRPTPRGAVMDIISRKDQRGSGQVGTYGLNTFTNMEVQLIRQMEAEGVITQDDMQNPKGLKERVEKWLRECGVDRLKRMAISGDDCVVKPLDERFGTSLLFLNDMGKVRKDIPQWEPSKGWKNWQEVPFCSHHFHKIFMKDGRSLVVPCRNQDELIGRARISQGAGWSLRETACLGKAYAQMWSLMYFHRRDLRLASMAICSAVPTEWFPTSRTTWSIHAHHQWMTTEDMLKVWNRVWIEDNPNMTDKTPIHSWEDIPYLGKREDLWCGSLIGLSSRATWAKNIHTAITQVRNLIGKEEYVDYMPVMKRYSAPSESEGVL

SEQ ID NO: 5176 - protein, 3288 aa, Artificial Sequence
  derived and/or modified protein sequence (wt) from DENV-4__GQ199881__SS-prME
STITLLCLIPTVMAFHLSTRDGEPLMIVAKHERGRPLLFKTTEGINKCTLIAMDLGEMCEDTVTYKCPLLVNTEPEDIDCWCNLTSTWVMYGTCTQSGERRREKRSVALTPHSGMGLETRAETWMSSEGAWKHAQRVESWILRNPGFALLAGFMAYMIGQTRIQRTVFFVLMMLVAPSYGMRCVGVGNRDFVEGVSGGAWVDLVLEHGGCVTTMAQGKPTLDFELTKTTAKEVALLRTYCIEASISNITTATRCPTQGEPYLKEEQDQQYICRRDVVDRGWGNGCGLFGKGGVVTCAKFSCSGKITGNLVQIENLEYTVVVTVHNGDTHAVGNDTSNHGVTATITPRSPSVEVKLPDYGELTLDCEPRSGIDFNEMILMKMKKKTWLVHKQWFLDLPLPWTAGADTSEVHWNYKERMVTFKVPHAKRQDVTVLGSQEGAMHSALAGATEVDSGDGNHMFAGHLKCKVRMEKLRIKGMSYTMCSGKFSIDKEMAETQHGTTVVKVKYEGAGAPCKVPIEIRDVNKEKVVGRVISSTPLAENTNSVTNIELEPPFGDSYIVIGVGNSALTLHWFRKGSSIGKMFESTYRGAKRMAILGETAWDFGSVGGLFTSLGKAVHQVFGSVYTTMFGGVSWMIRILIGFLVLWIGTNSRNTSMAMTCIAVGGITLFLGFTVQADMGCVVSWSGRELKCGSGIFVVDNVHTWTEQYKFQPESPARLASAILNAHKDGVCGIRSTTRLENVMWKQITNELNYVLWEGGHDLTVVAGDVKGVLTKGKRALTPPVSDLKYSWKTWGKAKIFTPEARNSTFLIDGPDTSECPNERRAWNSLEVEDYGFGMFTTNIWMKFREGSSEVCDHRLMSAAIKDQKAVHADMGYWIESSKNQTWQIEKASLIEVKTCLWPKTHTLWSNGVLESQMLIPKSYAGPFSQHNYRQGYATQTVGPWHLGKLEIDFGECPGTTVTIQEDCDHRGPSLRTTTASGKLVTQWCCRSCTMPPLRFLGEDGCWYGMEIRPLSEKEENMVKSQVAAGQGTSETFFMGLLCLTLFVEECLRRRVTRKHMILAVVITLCAIILGGLTWMDLLRALIMLGDTMSGRIGGQTHLAIMAVFKMSPGYVLGVFLRKLTSRETALMVIGMAMTTTLSIPHDLMELIDGISLGLILLKIVTQFDNTQVGTLALSLTFIRSTMSLVMAWRTIMAVLFVVTLIPLCRTSCLQKQSHWVEITALILGAQALPVYLMTLMKGASRRSWPLNEGMMAVGLVSLLGSALLKNDVPLAGPMVAGGLLLAAYVMSGSSADLSLEKAANVQWDEMADITGSSPIIEVKQDEDGSFSIRDVEETNMITLLVKLALITVSGLYPLAIPVTMTLWYMWQVKTQRSGALWDVPSPAATQKAALSEGVYRIMQRGLFGKTQVGVGIHMEGVFHTMWHVTRGSVICHETGRLEPSWADVRNDMISYGGGWRLGDKWDKEEDVQVLAIEPGKNPKHVQTKPGLFKTLTGEIGAVTLDFKPGSSGSPIINRKGKVIGLYGNGVVTKSGDYVSAITQAERIGEPDYEVDEDIFRKKRLTIMDLHPGAGKTKRILPSIVREALKRRLRTLILAPTRVVAAEMEEALRGLPIRYQTPAVKSEHTGREIVDLMCHATFTTRLLSSTRVPNYNLIVMDEAHFTDPSSVAARGYISTRVEMGEAAAIFMTATPPGATDPFPQSNSPIEDIEREIPERSWNTGFDWITDYQGKTVWFVPSIKAGNDIANCLRKSGKKVIQLSRKTFDTEYPKTKLTDWDFVVTTDISEMGANFRAGRVIDPRRCLKPVILTDGPERVILAGPIPVTPASAAQRRGRIGRNPAQEDDQYVFSGDPLKNDEDHAHWTEAKMLLDNIYTPEGIIPTLFGPEREKTQAIDGEFRLRGEQRKTFVELMRRGDLPVWLSYKVASAGISYKDREWCFTGERNNQILEENMEVEIWTREGEKKKLRPRWLDARVYADPMALKDFKEFASGRKSITLDILTEIASLPTYLSSRAKLALDNIVMLHTTERGGRAYQHALNELPESLETLMLVALLGAMTAGIFLFFMQGKGIGKLSMGLITIAVASGLLWVAEIQPQWIAASIILEFFLMVLLIPEPEKQRTPQDNQLIYVILAILTIIGLIAANEMGLIEKTKTDFGFYQVKTETTILDVDLRPASAWTLYAVATTILTPMLRHTIENTSANLSLAAIANQAAVLMGLGKGWPLHRMDLGVPLLAMGCYSQVNPTTLTASLVMLLVHYAIIGPGLQAKATREAQKRTAAGIMKNPTVDGITVIDLEPISYDPKFEKQLGQVMLLVLCAGQLLLMRTTWAFCEVLTLATGPILTLWEGNPGRFWNTTIAVSTANIFRGSYLAGAGLAFSLIKNAQTPRRGTGTTGETLGEKWKRQLNSLDRKEFEEYKRSGILEVDRTEAKSALKDGSKIKHAVSRGSSKIRWIVERGMVKPKGKVVDLGCGRGGWSYYMATLKNVTEVKGYTKGGPGHEEPIPMATYGWNLVKLHSGVDVFYKPTEQVDTLLCDIGESSSNPTIEEGRTLRVLKMVEPWLSSKPEFCIKVLNPYMPTVIEELEKLQRKHGGNLVRCPLSRNSTHEMYWVSGASGNIVSSVNTTSKMLLNRFTTRHRKPTYEKDVDLGAGTRSVSTETEKPDMTIIGRRLQRLQEEHKETWHYDQENPYRTWAYHGSYEAPSTGSASSMVNGVVKLLTKPWDVIPMVTQLAMTDTTPFGQQRVFKEKVDTRTPQPKPGTRMVMTTTANWLWALLGKKKNPRLCTREEFISKVRSNAAIGAVFQEEQGWTSASEAVNDSRFWELVDKERALHQEGKCESCVYNMMGKREKKLGEFGRAKGSRAIWYMWLGARFLEFEALGFLNEDHWFGRENSWSGVEGEGLHRLGYILEEIDKKDGDLMYADDTAGWDTRITEDDLQNEELITEQMAPHHKILAKAIFKLTYQNKVVKVLRPTPRGAVMDIISRKDQRGSGQVGTYGLNTFTNMEVQLIRQMEAEGVITQDDMQNPKGLKERVEKWLRECGVDRLKRMAISGDDCVVKPLDERFGTSLLFLNDMGKVRKDIPQWEPSKGWKNWQEVPFCSHHFHKIFMKDGRSLVVPCRNQDELIGRARISQGAGWSLRETACLGKAYAQMWSLMYFHRRDLRLASMAICSAVPTEWFPTSRTTWSIHAHHQWMTTEDMLKVWNRVWIEDNPNMIDKTPVHSWEDIPYLGKREDLWCGSLIGLSSRATWAKNIHTAITQVRNLIGKEEYVDYMPVMKRYSAPSESEGVL

SEQ ID NO: 5177 - protein, 3288 aa, Artificial Sequence
  derived and/or modified protein sequence (wt) from DENV-4__GQ199882__SS-prME
STITLLCLIPTVMAFHLSTRDGEPLMIVAKHERGRPLLFKTTEGINKCTLIAMDLGEMCEDTVTYKCPLLVNTEPEDIDCWCNLTSTWVMYGTCTQSGERRREKRSVALTPHSGMGLETRAETWMSSEGAWKHAQRVESWILRNPGFALLAGFMAYMIGQTGIQRTVFFVLMMLVAPSYGMRCVGVGNRDFVEGVSGGAWVDLVLEHGGCVTTMAQGKPTLDFELTKTTAKEVALLRTYCIEASISNITTATRCPTQGEPYLKEEQDQQYICRRDVVDRGWGNGCGLFGKGGVVTCAKFSCSGKITGNLVQIENLEYTVVVTVHNGDTHAVGNDTSNHGVTATITPRSPSVEVKLPDYGELTLDCEPRSGIDFNEMILMKMKKKTWLVHKQWFLDLPLPWTAGADTSEVHWNYKERMVTFKVPHAKRQDVTVLGSQEGAMHSALAGATEVDSGDGNHMFAGHLKCKVRMEKLRIKGMSYTMCSGKFSIDKEMAETQHGTTVVKVKYEGAGAPCKVPIEIRDVNKEKVVGRVISSTPLAENTNSVTNIELEPPFGDSYIVIGVGNSALTLHWFRKGSSIGKMFESTYRGAKRMAILGETAWDFGSVGGLFTSLGKAVHQVFGSVYTTMFGGVSWMIRILIGFLVLWIGTNSRNTSMAMTCIAVGGITLFLGFTVQADMGCVVSWSGRELKCGSGIFVVDNVHTWTEQYKFQPESPARLASAILNAHKDGVCGIRSTTRLENVMWKQITNELNYVLWEGGHDLTVVAGDVKGVLTKGKRALTPPVSDLKYSWKTWGKAKIFTPEARNSTFLIDGPDTSECPNERRAWNSLEVEDYGFGMFTTNIWMKFREGSSEVCDHRLMSAAIKDQKAVHADMGYWIESSKNQTWQIEKASLIEVKTCLWPKTHTLWSNGVLESQMLIPKSYAGPFSQHNYRQGYATQTVGPWHLGKLEIDFGECPGTTVTIQEDCDHRGPSLRTTTASGKLVTQWCCRSCTMPPLRFLGEDGCWYGMEIRPLSEKEENMVKSQVAAGQGTSETFSMGLLCLTLFVEECLRRRVTRKHMILAVVITLCAIILGGLTWMDLLRALIMLGDTMSGRIGGQTHLAIMAVFKMSPGYVLGVFLRKLTSRETALMVIGMAMTTTLSIPHDLMELIDGISLGLILLKIVTQFDNTQVGTLALSLTFIRSTMSLVMAWRTIMAVLFVVTLIPLCRTSCLQKQSHWVEITALILGAQALPVYLMTLMKGASRRSWPLNEGIMAVGLVSLLGSALLKNDVPLAGPMVAGGLLLAAYVMSGSSADLSLEKAANVQWDEMADITGSSPIIEVKQDEDGSFSIRDVEETNMITLLVKLALITVSGLYPLAIPVTMTLWYMWQVKTQRSGALWDVPSPAATQKAALSEGVYRIMQRGLFGKTQVGVGIHMEGVFHTMWHVTRGSVICHETGRLEPSWADVRNDMISYGGGWRLGDKWDKEEDVQVLAIEPGKNPKHVQTKPGLFKTLTGEIGAVTLDFKPGTSGSPIINRKGKVIGLYGNGVVTKSGDYVSAITQAERIGEPDYEVDEDIFRKKRLTIMDLHPGAGKTKRILPSIVREALKRRLRTLILAPTRVVAAEMEEALRGLPIRYQTPAVKSEHTGREIVDLMCHATFTTRLLSSTRVPNYNLIVMDEAHFTDPSSVAARGYISTRVEMGEAAAIFMTATPPGATDPFPQSNSPIEDIEREIPERSWNTGFDWITDYQGKTVWFVPSIKAGNDIANCLRKSGKKVIQLSRKTFDTEYPKTKLTDWDFVVTTDISEMGANFRAGRVIDPRRCLKPVILTDGSERVILAGPIPVTPASAAQRRGRIGRNPAQEDDQYVFSGDPLKNDEDHAHWTEAKMLLDNIYTPEGIIPTLFGPEREKTQAIDGEFRLRGEQRKTFVELMRRGDLPVWLSYKVASAGISYKDREWCFTGERNNQILEENMEVEIWTREGEKKKLRPRWLDARVYADPMALKDFKEFASGRKSITLDILTEIASLPTYLSSRAKLALDNIVMLHTTERGGRAYQHALNELPESLETLMLVALLGAMTAGIFLFFMQGKGIGKLSMGLITIAVASGLLWVAEIQPQWIAASIILEFFLMVLLIPEPEKQRTPQDNQLIYVILTILTIIGLIAANEMGLIEKTKTDFGFYQVKTETTILDVDLRPASAWTLYAVATTILTPMLRHTIENTSANLSLAAIANQAAVLMGLGKGWPLHRMDLGVPLLAMGCYSQVNPTTLTASLVMLLVHYAIIGPGLQAKATREAQKRTAAGIMKNPTVDGITVIDLEPISYDPKFEKQLGQVMLLVLCAGQLLLMRTTWAFCEVLTLATGPILTLWEGNPGRFWNTTIAVSTANIFRGSYLAGAGLAFSLIKNAQTPRRGTGTTGETLGEKWKRQLNSLDRKEFEEYKRSGILEVDRTEAKSALKDGSKIKHAVSRGSSKIRWIVERGMVKPKGKVVDLGCGRGGWSYYMATLKNVTEVKGYTKGGPGHEEPIPMATYGWNLVKLHSGVDVFYKPTEQVDTLLCDIGESSSNPTIEEGRTLRVLKMVEPWLSSKPEFCIKVLNPYMPTVIEELEKLQRKHGGNLVRCPLSRNSTHEMYWVSGASGNIVSSVNTTSKMLLNRFTTRHRKPTYEKDVDLGAGTRSVSTETEKPDMTIIGRRLQRLQEEHKETWHYDQENPYRTWAYHGSYEAPSTGSASSMVNGVVKLLTKPWDVIPMVTQLAMTDTTPFGQQRVFKEKVDTRTPQPKPGTRMVMTTTANWLWALLGKKKNPRLCTREEFISKVRSNAAIGAVFQEEQGWTSASEAVNDSRFWELVDKERALHQEGKCESCVYNMMGKREKKLGEFGRAKGSRAIWYMWLGARFLEFEALGFLNEDHWFGRENSWSGVEGEGLHRLGYILEEIDKKDGDLMYADDTAGWDTRITEDDLQNEELITEQMAPHHKILAKAIFKLTYQNKVVKVLRPTPRGAVMDIISRKDQRGSGQVGTYGLNTFTNMEVQLIRQMEAEGVITQDDMQNPKGLKERVEKWLRECGVDRLKRMAISGDDCVVKPLDERFGTSLLFLNDMGKVRKDIPQWEPSKGWKNWQEVPFCSHHFHKIFMKDGRSLVVPCRNQDELIGRARISQGAGWSLRETACLGKAYAQMWSLMYFHRRDLRLASMAICSAVPTEWFPTSRTTWSIHAHHQWMTTEDMLKVWNRVWIEDNPNMIDKTPVHSWEDIPYLGKREDLWCGSLIGLSSRATWAKNIHTAITQVRNLIGKEEYVDYMPVMKRYSAPSESEGVL

SEQ ID NO: 5178 - protein, 3288 aa, Artificial Sequence
  derived and/or modified protein sequence (wt) from DENV-4__GQ199883__SS-prME
STITLLCLIPTVMAFHLSTRDGEPLMIVAKHERGRPLLFKTTEGINKCTLIAMDLGEMCEDTVTYKCPLLVNTEPEDIDCWCNLTSTWVMYGTCTQSGERRREKRSVALTPHSGMGLETRAETWMSSEGAWKHAQRVESWILRNPGFALLAGFMAYMIGQTGIQRTVFFVLMMLVAPSYGMRCVGVGNRDFVEGVSGGAWVDLVLEHGGCVTTMAQGKPTLDFELTKTTAKEVALLRTYCIEASISNITTATRCPTQGEPYLKEEQDQQYICRRDVVDRGWGNGCGLFGKGGVVTCAKFSCSGKITGNLVQIENLEYTVVVTVHNGDTHAVGNDTSNHGVTATITPRSPSAEVKLPDYGELTLDCEPRSGIDFNEMILMKMKKKTWLVHKQWFLDLPLPWTAGADTSEVHWNYKERMVTFKVPHAKRQDVTVLGSQEGAMHSALAGATEVDSGDGNHMFAGHLKCKVRMEKLRIKGMSYTMCSGKFSIDKEMAETQHGTTVVKVKYEGAGAPCKVPIEIRDVNKEKVVGRVISSTPLAENTNSVTNIELEPPFGDSYIVIGVGNSALTLHWFRKGSSIGKMFESTYRGAKRMAILGETAWDFGSVGGLFTSLGKAVHQVFGSVYTTMFGGVSWMIRILIGFLVLWIGTNSRNTSMAMTCIAVGGITLFLGFTVQADMGCVVSWSGRELKCGSGIFVVDNVHTWTEQYKFQPESPARLASAILNAHKDGVCGIRSTTRLENVMWKQITNELNYVLWEGGHDLTVVAGDVKGVLTKGKRALTPPVSDLKYSWKTWGKAKIFTPEARNSTFLIDGPDTSECPNERRAWNSLEVEDYGFGMFTTNIWMKFREGSSEVCDHRLMSAAIKDQKAVHADMGYWIESSKNQTWQIEKASLIEVKTCLWPKTHTLWSNGVLESQMLIPKSYAGPFSQHNYRQGYATQTVGPWHLGKLEIDFGECPGTTVTIQEDCDHRGPSLRTTTASGKLVTQWCCRSCTMPPLRFLGEDGCWYGMEIRPLSEKEENMVKSQVAAGQGTSETFSMGLLCLTLFVEECLRRRVTRKHMILAVVITLCAIILGGLTWMDLLRALIMLGDTMSGRIGGQTHLAIMAVFKMSPGYVLGVFLRKLTSRETALMVIGMAMTTTLSIPHDLMELIDGISLGLILLKIVTQFDNTQVGTLALSLTFIRSTMSLVMAWRTIMAVLFVVTLIPLCRTSCLQKQSHWVEITALILGAQALPVYLMTLMKGASRRSWPLNEGIMAVGLVSLLGSALLKNDVPLAGPMVAGGLLLAAYVMSGSSADLSLEKAANVQWDEMADITGSSPIIEVKQDEDGSFSIRDVEETNMITLLVKLALITVSGLYPLAIPVTMTLWYMWQVKTQRSGALWDVPSPAATQKAALSEGVYRIMQRGLFGKTQVGVGIHMEGVFHTMWHVTRGSVICHETGRLEPSWADVRNDMISYGGGWRLGDKWDKEEDVQVLAIEPGKNPKHVQTKPGLFKTLTGEIGAVTLDFKPGTSGSPIINRKGKVIGLYGNGVVTKSGDYVSAITQAERIGEPDYEVDEDIFRKKRLTIMDLHPGAGKTKRILPSIVREALKRRLRTLILAPTRVVAAEMEEALRGLPIRYQTPAVKSEHTGREIVDLMCHATFTTRLLSSTRVPNYNLIVMDEAHFTDPSSVAARGYISTRVEMGEAAAIFMTATPPGATDPFPQSNSPIEDIEREIPERSWNTGFDWITDYQGKTVWFVPSIKAGNDIANCLRKSGKKVIQLSRKTFDTEYPKTKLTDWDFVVTTDISEMGANFRAGRVIDPRRCLKPVILTDGPERVILAGPIPVTPASAAQRRGRIGRNPAQEDDQYVFSGDPLKNDEDHAHWTEAKMLLDNIYTPEGIIPTLFGPEREKTQAIDGEFRLRGEQRKTFVELMRRGDLPVWLSYKVASAGISYKDREWCFTGERNNQILEENMEVEIWTREGEKKKLRPRWLDARVYADPMALKDFKEFASGRKSITLDILTEIASLPTYLSSRAKLALDNIVMLHTTERGGRAYQHALNELPESLETLMLVALLGAMTAGIFLFFMQGKGIGKLSMGLITIAVASGLLWVAEIQPQWIAASIILEFFLMVLLIPEPEKQRTPQDNQLIYVILAILTIIGLIAANEMGLIEKTKTDFGFYQVKTETTILDVDLRPASAWTLYAVATTILTPMLRHTIENTSANLSLAAIANQAAVLMGLGKGWPLHRMDLGVPLLAMGCYSQVNPTTLTASLVMLLVHYAIIGPGLQAKATREAQKRTAAGIMKNPTVDGITVIDLEPISYDPKFEKQLGQVMLLVLCAGQLLLMRTTWAFCEVLTLATGPILTLWEGNPGRFWNTTIAVSTANIFRGSYLAGAGLAFSLIKNAQTPRRGTGTTGETLGEKWKRQLNSLDRKEFEEYKRSGILEVDRTEAKSALKDGSKIKHAVSRGSSKIRWIVERGMVKPKGKVVDLGCGRGGWSYYMATLKNVTEVKGYTKGGPGHEEPIPMATYGWNLVKLHSGVDVFYKPTEQVDTLLCDIGESSSNPTIEEGRTLRVLKMVEPWLSSKPEFCIKVLNPYMPTVIEELEKLQRKHGGNLVRCPLSRNSTHEMYWVSGASGNIVSSVNTTSKMLLNRFTTRHRKPTYEKDVDLGAGTRSVSTETEKPDMTIIGRRLQRLQEEHKETWHYDQENPYRTWAYHGSYEAPSTGSASSMVNGVVKLLTKPWDVIPMVTQLAMTDTTPFGQQRVFKEKVDTRTPQPKPGTRMVMTTTANWLWALLGKKKNPRLCTREEFISKVRSNAAIGAVFQEEQGWTSASEAVNDSRFWELVDKERALHQEGKCESCVYNMMGKREKKLGEFGRAKGSRAIWYMWLGARFLEFEALGFLNEDHWFGRENSWSGVEGEGLHRLGYILEEIDKKDGDLMYADDTAGWDTRITEDDLQNEELITEQMAPHHKILAKAIFKLTYQNKVVKVLRPTPRGAVMDIISRKDQRGSGQVGTYGLNTFTNMEVQLIRQMEAEGVITQDDMQNPKGLKERVEKWLRECGVDRLKRMAISGDDCVVKPLDERFGTSLLFLNDMGKVRKDIPQWEPSKGWKNWQEVPFCSHHFHKIFMKDGRSLVVPCRNQDELIGRARISQGAGWSLRETACLGKAYAQMWSLMYFHRRDLRLASMAICSAVPTEWFPTSRTTWSIHAHHQWMTTEDMLKVWNRVWIEDNPNMIDKTPVHSWEDIPYLGKREDLWCGSLIGLSSRATWAKNIHTAITQVRNLIGKEEYVDYMPVMKRYSAPSESEGVL

SEQ ID NO: 5179 - protein, 3288 aa, Artificial Sequence
  derived and/or modified protein sequence (wt) from DENV-4__GQ199884__SS-prME
STITLLCLIPTVMAFHLSTRDGEPLMIVAKHERGRPLLFKTTEGINKCTLIAMDLGEMCEDTVTYKCPLLVNTEPEDIDCWCNLTSTWVMYGTCTQSGERRREKRSVALTPHSGMGLETRAETWMSSEGAWKHAQRVESWILRNPGFALLAGFMAYMIGQTGIQRTVFFVLMMLVAPSYGMRCVGVGNRDFVEGVSGGAWVDLVLEHGGCVTTMAQGKPTLDFELTKTTAKEVALLRTYCIEASISNITTATRCPTQGEPYLKEEQDQQYICRRDVVDRGWGNGCGLFGKGGVVTCAKFSCSGKITGNLVQIENLEYTVVVTVHNGDTHAVGNDTSNHGVTATITPRSPSVEVKLPDYGELTLDCEPRSGIDFNEMILMKMKKKTWLVHKQWFLDLPLPWTAGADTSEVHWNYKERMVTFKVPHAKRQDVTVLGSQEGAMHSALAGATEVDSGDGNHMFAGHLKCKVRMEKLRIKGMSYTMCSGKFSIDKEMAETQHGTTVVKVKYEGAGAPCKVPIEIRDVNKEKVVGRVISSTPLAENTNSVTNIELEPPFGDSYIVIGVGNSALTLHWFRKGSSIGKMFESTYRGAKRMAILGETAWDFGSVGGLFTSLGKAVHQVFGSVYTTMFGGVSWMIRILIGFLVLWIGTNSRNTSMAMTCIAVGGITLFLGFTVQADMGCVVSWSGRELKCGSGIFVVDNVHTWTEQYKFQPESPARLASAILNAHKDGVCGIRSTTRLENVMWKQITNELNYVLWEGGHDLTVVAGDVKGVLTKGKRALTPPVSDLKYSWKTWGKAKIFTPEARNSTFLIDGPDTSECPNERRAWNSLEVEDYGFGMFTTNIWMKFREGSSEVCDHRLMSAAIKDQKAVHADMGYWIESSKNQTWQIEKASLIEVKTCLWPKTHTLWSNGVLESQMLIPKSYAGPFSQHNYRQGYATQTVGPWHLGKLEIDFGECPGTTVTIQEDCDHRGPSLRTTTASGKLVTQWCCRSCTMPPLRFLGEDGCWYGMEIRPLSEKEENMVKSQVAAGQGTSETFSMGLLCLTLFVEECLRRRVTRKHMILAVVITLCAIILGGLTWMDLLRALIMLGDTMSGRIGGQTHLAIMAVFKMSPGYVLGVFLRKLTSRETALMVIGMAMTTTLSIPHDLMELIDGISLGLILLKIVTQFDNTQVGTLALSLTFIRSTMSLVMAWRTIMAVLFVVTLIPLCRTSCLQKQSHWVEITALILGAQALPVYLMTLMKGASRRSWPLNEGIMAVGLVSLLGSALLKNDVPLAGPMVAGGLLLAAYVMSGSSADLSLEKAANVQWDEMADITGSSPIIEVKQDEDGSFSIRDVEETNMITLLVKLALITVSGLYPLAIPVTMTLWYMWQVKTQRSGALWDVPSPAATQKAALSEGVYRIMQRGLFGKTQVGVGIHMEGVFHTMWHVTRGSVICHETGRLEPSWADVRNDMISYGGGWRLGDKWDKEEDVQVLAIEPGKNPKHVQTKPGLFKTLTGEIGAVTLDFKPGTSGSPIINRKGKVIGLYGNGVVTKSGDYVSAITQAERIGEPDYEVDEDIFRKKRLTIMDLHPGAGKTKRILPSIVREALKRRLRTLILAPTRVVAAEMEEALRGLPIRYQTPAVKSEHTGREIVDLMCHATFTTRLLSSTRVPNYNLIVMDEAHFTDPSSVAARGYISTRVEMGEAAAIFMTATPPGATDPFPQSNSPIEDIEREIPERSWNTGFDWITDYQGKTVWFVPSIKAGNDIANCLRKSGKKVIQLSRKTFDTEYPKTKLTDWDFVVTTDISEMGANFRAGRVIDPRRCLKPVILTDGPERVILAGPIPVTPASAAQRRGRIGRNPAQEDDQYVFSGDPLKNDEDHAHWTEAKMLLDNIYTPEGIIPTLFGPEREKTQAIDGEFRLRGEQRKTFVELMRRGDLPVWLSYKVASAGISYKDREWCFTGERNNQILEENMEVEIWTREGEKKKLRPRWLDARVYADPMALKDFKEFASGRKSITLDILTEIASLPTYLSSRAKLALDNIVMLHTTERGGRAYQHALNELPESLETLMLVALLGAMTAGIFLFFMQGKGIGKLSMGLITIAVASGLLWVAEIQPQWIAASIILEFFLMVLLIPEPEKQRTPQDNQLIYVILAILTIIGLIAANEMGLIEKTKTDFGFYQVKTETTILDVDLRPASAWTLYAVATTILTPMLRHTIENTSANLSLAAIANQAAVLMGLGKGWPLHRMDLGVPLLAMGCYSQVNPTTLTASLVMLLVHYAIIGPGLQAKATREAQKRTAAGIMKNPTVDGITVIDLEPISYDPKFEKQLGQVMLLVLCAGQLLLMRTTWAFCEVLTLATGPILTLWEGNPGRFWNTTIAVSTANIFRGSYLAGAGLAFSLIKNAQTPRRGTGTTGETLGEKWKRQLNSLDRKEFEEYKRSGILEVDRTEAKSALKDGSKIKHAVSRGSSKIRWIVERGMVKPKGKVVDLGCGRGGWSYYMATLKNVTEVKGYTKGGPGHEEPIPMATYGWNLVKLHSGVDVFYKPTEQVDTLLCDIGESSSNPTIEEGRTLRVLKMVEPWLSSKPEFCIKVLNPYMPTVIEELEKLQRKHGGNLVRCPLSRNSTHEMYWVSGASGNIVSSVNTTSKMLLNRFTTRHRKPTYEKDVDLGAGTRSVSTETEKPDMTIIGRRLQRLQEEHKETWHYDQENPYRTWAYHGSYEAPSTGSASSMVNGVVKLLTKPWDVIPMVTQLAMTDTTPFGQQRVFKEKVDTRTPQPKPGTRMVMTTTANWLWALLGKKKNPRLCTREEFISKVRSNAAIGAVFQEEQGWTSASEAVNDSRFWELVDKERALHQEGKCESCVYNMMGKREKKLGEFGRAKGSRAIWYMWLGARFLEFEALGFLNEDHWFGRENSWSGVEGEGLHRLGYILEEIDKKDGDLMYADDTAGWDTRITEDDLQNEELITEQMAPHHKILAKAIFKLTYQNKVVKVLRPTPRGAVMDIISRKDQRGSGQVGTYGLNTFTNMEVQLIRQMEAEGVITQDDMQNPKGLKERVEKWLRECGVDRLKRMAISGDDCVVKPLDERFGTSLLFLNDMGKVRKDIPQWEPSKGWKNWQEVPFCSHHFHKIFMKDGRSLVVPCRNQDELIGRARISQGAGWSLRETACLGKAYAQMWSLMYFHRRDLRLASMAICSAVPTEWFPTSRTTWSIHAHHQWMTTEDMLKVWNRVWIEDNPNMIDKTPVHSWEDIPYLGKREDLWCGSLIGLSSRATWAKNIHTAITQVRNLIGKEEYVDYMPVMKRYSAPSESEGVL

SEQ ID NO: 5180 - protein, 3288 aa, Artificial Sequence
  derived and/or modified protein sequence (wt) from DENV-4__FJ882595__SS-prME
STITLLCLIPTAMAFHLSTRDGEPLMIVAKHERGRPLLFKTTEGINKCTLIAMDLGEMCEDTVTYKCPLLVNTEPEDIDCWCNLTSTWVMYGTCTQSGERRREKRSVALTPHSGMGLETRAETWMSSEGAWKHAQRVESWILRNPGFALLAGFMAYMIGQTGIQRTVFFVLMMLVAPSYGMRCVGVGNRDFVEGVSGGAWVDLVLEHGGCVTTMAQGKPTLDFELTKTTAKEVALLRTYCIEASISNITTATRCPTQGEPYLKEEQDQQYICRRDVVDRGWGNGCGLFGKGGVVTCAKFSCSGKITGNLVQIENLEYTVVVTVHNGDTHAVGNDTSNHGVTATITPRSPSVEVKLPDYGELTLDCEPRSGIDFNEMILMKMKKKTWLVHKQWFLDLPLPWTAGADTSEVHWNYKERMVTFKVPHAKRQDVTVLGSQEGAMHSALAGATEVDSGDGNHMFAGHLKCKVRMEKLRIKGMSYTMCSGKFSIDKEMAETQHGTTVVKVKYEGAGAPCKVPIEIRDVNKEKVVGRVISSTPLAENTNSVTNIELEPPFGDSYIVIGVGNSALTLHWFRKGSSIGKMFESTYRGAKRMAILGETAWDFGSVGGLFTSLGKAVHQVFGSVYTTMFGGVSWMIRILIGFLVLWIGTNSRNTSMAMTCIAVGGITLFLGFTVQADMGCVVSWSGRELKCGSGIFVVDNVHTWTEQYKFQPESPARLASAILNAHKDGVCGIRSTTRLENVMWKQITNELNYVLWEGGHDLTVVAGDVKGVLTKGKRALTPPVSDLKYSWKTWGKAKIFTPEARNSTFLIDGPDTSECPNERRAWNSLEVEDYGFGMFTTNIWMKFREGSSEVCDHRLMSAAIKDQKAVHADMGYWIESSKNQTWQIEKASLIEVKTCLWPKTHTLWSNGVLESQMLIPKSYAGPFSQHNYRQGYATQTVGPWHLGKLEIDFGECPGTTVTIQEDCDHRGPSLRTTTASGKLVTQWCCRSCTMPPLRFLGEDGCWYGMEIRPLSEKEENMVKSQVAAGQGTSETFSMGLLCLTLFVEECLRRRVTRKHMILAVVITLCAIILGGLTWMDLLRALIMLGDTMSGRIGGQTHLAIMAVFKMSPGYVLGVFLRKLTSRETALMVIGMAMTTTLSIPHDLMELIDGISLGLILLKIVTQFDNTQVGTLALSLTFIRSTMSLVMAWRTIMAVLFVVTLIPLCRTSCLQKQSHWVEITALILGAQALPVYLMTLMKGASRRSWPLNEGIMAVGLVSLLGSALLKNDVPLAGPMVAGGLLLAAYVMSGSSADLSLEKAANVQWDEMADITGSSPIIEVKQDEDGSFSIRDVEETNMITLLVKLALITVSGLYPLAIPVTMTLWYMWQVKTQRSGALWDVPSPAATQKAALSEGVYRIMQRGLFGKTQVGVGIHMEGVFHTMWHVTRGSVICHETGRLEPSWADVRNDMISYGGGWRLGDKWDKEEDVQVLAIEPGKNPKHVQTKPGLFKTLTGEIGAVTLDFKPGTSGSPIINRKGKVIGLYGNGVVTKSGDYVSAITQAERIGEPDYEVDEDIFRKKRLTIMDLHPGAGKTKRILPSIVREALKRRLRTLILAPTRVVAAEMEEALRGLPIRYQTPAVKSEHTGREIVDLMCHATFTTRLLSSTRVPNYNLIVMDEAHFTDPSSVAARGYISTRVEMGEAAAIFMTATPPGATDPFPQSNSPIEDIEREIPERSWNTGFDWITDYQGKTVWFVPSIKAGNDIANCLRKSGKKVIQLSRKTFDTEYPKTKLTDWDFVVTTDISEMGANFRAGRVIDPRRCLKPVILTDGPERVILAGPIPVTPASAAQRRGRIGRNPAQEDDQYVFSGDPLKNDEDHAHWTEAKMLLDNIYTPEGIIPTLFGPEREKTQAIDGEFRLRGEQRKTFVELMRRGDLPVWLSYKVASAGISYKDREWCFTGERNNQILEENMEVEIWTREGEKKKLRPRWLDARVYADPMALKDFKEFASGRKSITLDILTEIASLPTYLSSRAKLALDNIVMLHTTERGGRAYQHALNELPESLETLMLVALLGAMTAGIFLFFMQGTGIGKLSMGLITIAVASGLLWVAEIQPQWIAASIILEFFLMVLLIPEPEKQRTPQDNQLIYVILTILTIIGLIAANEMGLIEKTKTDFGFYQVKTETTILDVDLRPASAWTLYAVATTILTPMLRHTIENTSANLSLAAIANQAAVLMGLGKGWPLHRMDLGVPLLAMGCYSQVNPTTLTASLVMLLVHYAIIGPGLQAKATREAQKRTAAGIMKNPTVDGITVIDLEPISYDPKFEKQLGQVMLLVLCAGQLLLMRTTWAFCEVLTLATGPILTLWEGNPGRFWNTTIAVSTANIFRGSYLAGAGLAFSLIKNAQTPRRGTGTTGETLGEKWKRQLNSLDRKEFEEYKRSGILEVDRTEAKSALKDGSKIKHAVSRGSSKIRWIVERGMVKPKGKVVDLGCGRGGWSYYMATLKNVTEVKGYTKGGPGHEEPIPMATYGWNLVKLHSGVDVFYKPTEQVDTLLCDIGESSSNPTIEEGRTLRVLKMVEPWLSSKPEFCIKVLNPYMPTVIEELEKLQRKHGGNLVRCPLSRNSTHEMYWVSGASGNIVSSVNTTSKMLLNRFTTRHRKPTYEKDVDLGAGTRSVSTETEKPDMTIIGRRLQRLQEEHKETWHYDQENPYRTWAYHGSYEAPSTGSASSMVNGVVKLLTKPWDVIPMVTQLAMTDTTPFGQQRVFKEKVDTRTPQPKPGTRMVMTTTANWLWALLGKKKNPRLCTREEFISKVRSNAAIGAVFQEEQGWTSASEAVNDSRFWELVDKERALHQEGKCESCVYNMMGKREKKLGEFGRAKGSRAIWYMWLGARFLEFEALGFLNEDHWFGRENSWSGVEGEGLHRLGYILEEIDKKDGDLMYADDTAGWDTRITEDDLQNEELITEQMAPHHKILAKAIFKLTYQNKVVKVLRPTPRGAVMDIISRKDQRGSGQVGTYGLNTFTNMEVQLIRQMEAEGVITQDDMQNPKGLKERVEKWLRECGVDRLKRMAISGDDCVVKPLDERFGTSLLFLNDMGKVRKDIPQWEPSKGWKNWQEVPFCSHHFHKIFMKDGRSLVVPCRNQDELIGRARISQGAGWSLRETACLGKAYAQMWSLMYFHRRDLRLASMAICSAVPTEWFPTSRTTWSIHAHHQWMTTEDMLKVWNRVWIEDNPNMIDKTPVHSWEDIPYLGKREDLWCGSLIGLSSRATWAKNIHTAITQVRNLIGKEEYVDYMPVMKRYSAPSESEGVL

SEQ ID NO: 5181 - protein, 3288 aa, Artificial Sequence
  derived and/or modified protein sequence (wt) from DENV-4__FJ882596__SS-prME
STITLLCLIPTVMAFHLSTRDGEPLMIVAKHERGRPLLFKTTEGINKCTLIAMDLGEMCEDTVTYKCPLLVNTEPEDIDCWCNLTSTWVMYGTCTQSGERRREKRSVALTPHSGMGLETRAETWMSSEGAWKHAQRVESWILRNPGFALLAGFMAYMIGQTGIQRTVFFVLMMLVAPSYGMRCVGVGNRDFVEGVSGGAWVDLVLEHGGCVTTMAQGKPTLDFELTKTTAKEVALLRTYCIEASISNITTATRCPTQGEPYLKEEQDQQYICRRDVVDRGWGNGCGLFGKGGVVTCAKFSCSGKITGNLVQIENLEYTVVVTVHNGDTHAVGNDTSNHGVTATITPRSPSVEVKLPDYGELTLDCEPRSGIDFNEMILMKMKKKTWLVHKQWFLDLPLPWTAGADTSEVHWNYKERMVTFKVPHAKRQDVTVLGSQEGAMHSALAGATEVDSGDGNHMFAGHLKCKVRMEKLRIKGMSYTMCSGKFSIDKEMAETQHGTTVVKVKYEGAGAPCKVPIEIRDVNKEKVVGRVISSTPLAENTNSVTNIELEPPFGDSYIVIGVGNSALTLHWFRKGSSIGKMFESTYRGAKRMAILGETAWDFGSVGGLFTSLGKAVHQVFGSVYTTMFGGVSWMIRILIGFLVLWIGTNSRNTSMAMTCIAVGGITLFLGFTVQADMGCVVSWSGRELKCGSGIFVVDNVHTWTEQYKFQPESPARLASAILNAHKDGVCGIRSTTRLENVMWKQITNELNYVLWEGGHDLTVVAGDVRGVLTKGKRALTPPVSDLKYSWKTWGKAKIFTPEARNSTFLIDGPDTSECPNERRAWNSLEVEDYGFGMFTTNIWMKFREGSSEVCDHRLMSAAIKDQKAVHADMGYWIESSKNQTWQIEKASLIEVKTCLWPKTHTLWSNGVLESQMLIPKSYAGPFSQHNYRQGYATQTVGPWHLGKLEIDFGECPGTTVTIQEDCDHRGPSLRTTTASGKLVTQWCCRSCTMPPLRFLGEDGCWYGMEIRPLSEKEENMVKSQVAAGQGTSETFSMGLLCLTLFVEECLRRRVTRKHMILAVVITLCAIILGGLTWMDLLRALIMLGDTMSGRIGGQTHLAIMAVFKMSPGYVLGVFLRKLTSRETALMVIGMAMTTTLSIPHDLMELIDGISLGLILLKIVTQFDNTQVGTLALSLTFIRSTMSLVMAWRTIMAVLFVVTLIPLCRTSCLQKQSHWVEITALILGAQALPVYLMTLMKGASRRSWPLNEGIMAVGLVSLLGSALLKNDVPLAGPMVAGGLLLAAYVMSGSSADLSLEKAANVQWDEMADITGSSPIIEVKQDEDGSFSIRDVEETNMITLLVKLALITVSGLYPLAIPVTMTLWYMWQVKTQRSGALWDVPSPAATQKAALSEGVYRIMQRGLFGKTQVGVGIHMEGVFHTMWHVTRGSVICHETGRLEPSWADVRNDMISYGGGWRLGDKWDKEEDVQVLAIEPGKNPKHVQTKPGLFKTLTGEIGAVTLDFKPGTSGSPIINRKGKVIGLYGNGVVTKSGDYVSAITQAERIGEPDYEVDEDIFRKKRLTIMDLHPGAGKTKRILPSIVREALKRRLRTLILAPTRVVAAEMEEALRGLPIRYQTPAVKSEHTGREIVDLMCHATFTTRLLSSTRVPNYNLIVMDEAHFTDPSSVAARGYISTRVEMGEAAAIFMTATPPGATDPFPQSNSPIEDIEREIPERSWNTGFDWITDYQGKTVWFVPSIKAGNDIANCLRKSGKKVIQLSRKTFDTEYPKTKLTDWDFVVTTDISEMGANFRAGRVIDPRRCLKPVILTDGPERVILAGPIPVTPASAAQRRGRIGRNPAQEDDQYVFSGDPLKNDEDHAHWTEAKMLLDNIYTPEGIIPTLFGPEREKTQAIDGEFRLRGEQRKTFVELMRRGDLPVWLSYKVASAGISYKDREWCFTGERNNQILEENMEVEIWTREGEKKKLRPRWLDARVYADPMALKDFKEFASGRKSITLDILTEIASLPTYLSSRAKLALDNIVMLHTTERGGRAYQHALNELPESLETLMLVALLGAMTAGIFLFFMQGKGIGKLSMGLITIAVASGLLWVAEIQPQWIAASIILEFFLMVLLIPEPEKQRTPQDNQLIYVILTILTIIGLIAANEMGLIEKTKTDFGFYQVKTETTILDVDLRPASAWTLYAVATTILTPMLRHTIENTSANLSLAAIANQAAVLMGLGKGWPLHRMDLGVPLLAMGCYSQVNPTTLTASLVMLLVHYAIIGPGLQAKATREAQKRTAAGIMKNPTVDGITVIDLEPISYDPKFEKQLGQVMLLVLCAGQLLLMRTTWAFCEVLTLATGPILTLWEGNPGRFWNTTIAVSTANIFRGSYLAGAGLAFSLIKNAQTPRRGTGTTGETLGEKWKRQLNSLDRKEFEEYKRSGILEVDRTEAKSALKDGSKIKHAVSRGSSKIRWIVERGMVKPKGKVVDLGCGRGGWSYYMATLKNVTEVKGYTKGGPGHEEPIPMATYGWNLVKLHSGVDVFYKPTEQVDTLLCDIGESSSNPTIEEGRTLRVLKMVEPWLSSKPEFCIKVLNPYMPTVIEELEKLQRKHGGNLVRCPLSRNSTHEMYWVSGASGNIVSSVNTTSKMLLNRFTTRHRKPTYEKDVDLGAGTRSVSTETEKPDMTIIGRRLQRLQEEHKETWHYDQENPYRTWAYHGSYEAPSTGSASSMVNGVVKLLTKPWDVIPMVTQLAMTDTTPFGQQRVFKEKVDTRTPQPKPGTRMVMTTTANWLWALLGKKKNPRLCTREEFISKVRSNAAIGAVFQEEQGWTSASEAVNDSRFWELVDKERALHQEGKCESCVYNMMGKREKKLGEFGRAKGSRAIWYMWLGARFLEFEALGFLNEDHWFGRENSWSGVEGEGLHRLGYILEEIDKKDGDLMYADDTAGWDTRITEDDLQNEELITEQMAPHHKILAKAIFKLTYQNKVVKVLRPTPRGAVMDIISRKDQRGSGQVGTYGLNTFTNMEVQLIRQMEAEGVITQDDMQNPKGLKERVEKWLRECGVDRLKRMAISGDDCVVKPLDERFGTSLLFLNDMGKVRKDIPQWEPSKGWKNWQEVPFCSHHFHKIFMKDGRSLVVPCRNQDELIGRARISQGAGWSLRETACLGKAYAQMWSLMYFHRRDLRLASMAICSAVPTEWFPTSRTTWSIHAHHQWMTTEDMLKVWNRVWIEDNPNMIDKTPVHSWEDIPYLGKREDLWCGSLIGLSSRATWAKNIHTAITQVRNLIGKEEYVDYMPVMKRYSAPSESEGVL

SEQ ID NO: 5182 - protein, 3288 aa, Artificial Sequence
  derived and/or modified protein sequence (wt) from DENV-4__FJ850059__SS-prME
STITLLCLIPTVMAFHLSTRDGEPLMIVAKHERGRPLLFKTTEGINKCTLIAMDLGEMCEDTVTYKCPLLVNTEPEDIDCWCNLTSTWVMYGTCTQSGERRREKRSVALTPHSGMGLETRAETWMSSEGAWKHAQRVESWILRNPGFALLAGFMAYMIGQTGIQRTVFFVLMMLVAPSYGMRCVGVGNRDFVEGVSGGVWVDLVLEHGGCVTTMAQGKPTLDFELTKTTAKEVALLRTYCIEASISNITTATRCPTQGEPYLKEEQDQQYICRRDVVDRGWGNGCGLFGKGGVVTCAKFSCSGKITGNLVQIENLEYTVVVTVHNGDTHAVGNDTSNHGVTATITPRSPSVEVKLPDYGELTLDCEPRSGIDFNEMILMKMKKKTWLVHKQWFLDLPLPWTAGADTSEVHWNYKERMVTFKVPHAKRQDVTVLGSQEGAMHSALAGATEVDSGDGNHMFAGHLKCKVRMEKLRIKGMSYTMCSGKFSIDKEMAETQHGTTVVKVKYEGAGAPCKVPIEIRDVNKEKVVGRVISSTPLAENTNSVTNIELEPPFGDSYIVIGVGNSALTLHWFRKGSSIGKMFESTYRGAKRMAILGETAWDFGSVGGLFTSLGKAVHQVFGSVYTTMFGGVSWMIRILIGFLVLWIGTNSRNTSMAMTCIAVGGITLFLGFTVQADMGCVVSWSGRELKCGSGIFVVDNVHTWTEQYKFQPESPARLASAILIAHKDGVCGIRSTTRLENVMWKQITNELNYVLWEGGHDLTVVAGDAKGVLTKGKRALTPPVSDLKYSWKTWGKAKIFTPEARNSTFLIDGPDTSECPNERRAWNSLEVEDYGFGMFTTNIWMKFREGSSEVCDHRLMSAAIKDQKAVHADMGYWIESSKNQTWQIEKASLIEVKTCLWPKTHTLWSNGVLESQMLIPKSYAGPFSQHNYRQGYATQTVGPWHLGKLEIDFGECPGTTVTIQEDCDHRGPSLRTTTASGKLVTQWCCRSCTMPPLRFLGEDGCWYGMEIRPLSEKEENMVKSQVTAGQGTSETFSMGLLCLTLFVEECLRRRVTRKHMILAVVITLCAIILGGLTWMDLLRALIMLGDTMSGRIGGQTHLAIMAVFKMSPGYVLGVFLRKLTSRETALMVIGMAMTTTLSIPHDLMELIDGISLGLILLKIVTQFDNTQVGTLALSLTFIRSTMSLVMAWRTIMAVLFVVTLIPLCRTSCLQKQSHWVEITALILGAQALPVYLMTLMKGASRRSWPLNEGIMAVGLVSLLGSALLKNDVPLAGPMVAGGLLLAAYVMSGSSADLSLEKAANVQWDEMADITGSSPIIEVKQDEDGSFSIRDVEETNMITLLVKLALITVSGLYPLAIPVTMTLWYMWQVKTQRSGALWDVPSPAATQKAALSEGVYRIMQRGLFGKTQVGVGIHMEGVFHTMWHVTRGSVICHETGRLEPSWADVRNDMISYGGGWRLGDKWDKEEDVQVLAIEPGKNPKHVQTKPGLFKTLTGEIGAVTLDFKPGTSGSPIINRKGKVIGLYGNGVVTKSGDYVSAITQAERIGEPDYEVDEDIFRKKRLTIMDLHPGAGKTKRILPSIVREALKRRLRTLILAPTRVVAAEMEEALRGLPIRYQTPAVKSEHTGREIVDLMCHATFTTRLLSSTRVPNYNLIVMDEAHFTDPSSVAARGYISTRVEMGEAAAIFMTATPPGATDPFPQSNSPIEDIEREIPERSWNTGFDWITDYQGKTVWFVPSIKAGNDIANCLRKSGKKVIQLSRKTFDTEYPKTKLTDWDFVVTTDISEMGANFRAGRVIDPRRCLKPVILTDGPERVILAGPIPVTPASAAQRRGRIGRNPAQEDDQYVFSGDPLKNDEDHAHWTEAKMLLDNIYTPEGIIPTLFGPEREKTQAIDGEFRLRGEQRKTFVELMRRGDLPVWLSYKVASAGISYKDREWCFTGERNNQILEENMEVEIWTREGEKKKLRPRWLDARVYADPMALKDFKEFASGRKSITLDILTEIASLPTYLSSRAKLALDNIVMLHTTERGGRAYQHALNELPESLETLMLVALLGAMTAGIFLFFMQGKGIGKLSMGLITIAVASGLLWVAEIQPQWIAASIILEFFLMVLLIPEPEKQRTPQDNQLIYVILTILTIIGLIAANEMGLIEKTKTDFGFYQVKTETTILDVDLRPASAWTLYAVATTILTPMLRHTIENTSANLSLAAIANQAAVLMGLGKGWPLHRMDLGVPLLAMGCYSQVNPTTLTASLVMLLVHYAIIGPGLQAKATREAQKRTAAGIMKNPTVDGITVIDLEPISYDPKFEKQLGQVMLLVLCAGQLLLMRTTWAFCEVLTLATGPILTLWEGNPGRFWNTTIAVSTANIFRGSYLAGAGLAFSLIKNAQTPRRGTGTTGETLGEKWKRQLNSLDRKEFEEYKRSGILEVDRTEAKSALKDGSKIKHAVSRGSSKIRWIVERGMVKPKGKVVDLGCGRGGWSYYMATLKNVTEVKGYTKGGPGHEEPIPMATYGWNLVKLHSGVDVFYRPTEQVDTLLCDIGESSSNPTIEEGRTLRVLKMVEPWLSSKPEFCIKVLNPYMPTVIEELEKLQRKHGGNLVRCPLSRNSTHEMYWVSGASGNIVSSVNTTSKMLLNRFTTRHRKPTYEKDVDLGAGTRSVSTETEKPDMTIIGRRLQRLQEEHKETWHYDQENPYRTWAYHGSYEAPSTGSASSMVNGVVKLLTKPWDVIPMVTQLAMTDTTPFGQQRVFKEKVDTRTPQPKPGTRMVMTTTANWLWALLGKKKNPRLCTREEFISKVRSNAAIGAVFQEEQGWTSASEAVNDSRFWELVDKERALHQEGKCESCVYNMMGKREKKLGEFGRAKGSRAIWYMWLGARFLEFEALGFLNEDHWFGRENSWSGVEGEGLHRLGYILEEIDKKDGDLMYADDTAGWDTRITEDDLQNEELITEQMAPHHKILAKAIFKLTYQNKVVKVLRPTPRGAVMDIISRKDQRGSGQVGTYGLNTFTNMEVQLIRQMEAEGVITQDDMQNPKGLKERVEKWLRECGVDRLKRMAISGDDCVVKPLDERFGTSLLFLNDMGKVRKDIPQWEPSKGWKNWQEVPFCSHHFHKIFMKDGRSLVVPCRNQDELIGRARISQGAGWSLRETACLGKAYAQMWSLMYFHRRDLRLASMAICSAVPTEWFPTSRTTWSIHAHHQWMTTEDMLKVWNRVWIEDNPNMIDKTPVHSWEDIPYLGKREDLWCGSLIGLSSRATWAKNIHTAITQVRNLIGKEEYVDYMPVMKRYSAPSESEGVL

SEQ ID NO: 5183 - protein, 3288 aa, Artificial Sequence
  derived and/or modified protein sequence (wt) from DENV-4__FJ882598__SS-prME
STITLLCLIPTAMAFHLSTRDGEPLMIVAKHERGRPLLFKTTEGINKCTLIAMDLGEMCEDTVTYKCPLLVNTEPEDIDCWCNLTSTWVMYGTCTQSGERRREKRSVALTPHSGMGLETRAETWMSSEGAWKHAQRVESWILRNPGFALLAGFMAYMIGQTGIQRTVFFVLMMLVAPSYGMRCVGVGNRDFVEGVSGGAWVDLVLEHGGCVTTMAQGKPTLDFELTKTTAKEVALLRTYCIEASISNITTATRCPTQGEPYLKEEQDQQYICRRDVVDRGWGNGCGLFGKGGVVTCAKFSCSGKITGNLVQIENLEYTVVVTVHNGDTHAVGNDTSNHGVTATITPRSPSVEVKLPDYGELTLDCEPRSGIDFNEMILMKMKKKTWLVHKQWFLDLPLPWTAGADTSEVHWNYKERMVTFKVPHAKRQDVTVLGSQEGAMHSALAGATEVDSGDGNHMFAGHLKCKVRMEKLRIKGMSYTMCSGKFSIDKEMAETQHGTTVVKVKYEGAGAPCKVPIEIRDVNKEKVVGRVISSTPLAENTNSVTNIELEPPFGDSYIVIGVGNSALTLHWFRKGSSIGKMFESTYRGAKRMAILGETAWDFGSVGGLFTSLGKAVHQVFGSVYTTMFGGVSWMIRILIGFLVLWIGTNSRNTSMAMTCIAVGGITLFLGFTVQADMGCVVSWSGRELKCGSGIFVVDNVHTWTEQYKFQPESPARLASAILNAHKDGVCGIRSTTRLENVMWKQITNELNYVLWEGGHDLTVVAGDVKGVLTKGKRALTPPVSDLKYSWKTWGKAKIFTPEARNSTFLIDGPDTSECPNERRAWNSLEVEDYGFGMFTTNIWMKFREGSSEVCDHRLMSAAIKDQKAVHADMGYWIESSKNQTWQIEKASLIEVKTCLWPKTHTLWSNGVLESQMLIPKSYAGPFSQHNYRQGYATQTVGPWHLGKLEIDFGECPGTTVTIQEDCDHRGPSLRTTTASGKLVTQWCCRSCTMPPLRFLGEDGCWYGMEIRPLSEKEENMVKSQVAAGQGTSETFSMGLLCLTLFVEECLRRRVTRKHMILAVVITLCAIILGGLTWMDLLRALIMLGDTMSGRIGGQTHLAIMAVFKMSPGYVLGVFLRKLTSRETALMVIGMAMTTTLSIPHDLMELIDGISLGLILLKIVTQFDNTQVGTLALSLTFIRSTMSLVMAWRTIMAVLFVVTLIPLCRTSCLQKQSHWVEITALILGAQALPVYLMTLMKGASRRSWPLNEGIMAVGLVSLLGSALLKNDVPLAGPMVAGGLLLAAYVMSGSSADLSLEKAANVQWDEMADITGSSPIIEVKQDEDGSFSIRDVEETNMITLLVKLALITVSGLYPLAIPVTMTLWYMWQVKTQRSGALWDVPSPAATQKAALSEGVYRIMQRGLFGKTQVGVGIHMEGVFHTMWHVTRGSVICHETGRLEPSWADVRNDMISYGGGWRLGDKWDKEEDVQVLAIEPGKNPKHVQTKPGLFKTLTGEIGAVTLDFKPGTSGSPIINRKGKVIGLYGNGVVTKSGDYVSAITQAERIGEPDYEVDEDIFRKKRLTIMDLHPGAGKTKRILPSIVREALKRRLRTLILAPTRVVAAEMEEALRGLPIRYQTPAVKSEHTGREIVDLMCHATFTTRLLSSTRVPNYNLIVMDEAHFTDPSSVAARGYISTRVEMGEAAAIFMTATPPGATDPFPQSNSPIEDIEREIPERSWNTGFDWITDYQGKTVWFVPSIKAGNDIANCLRKSGKKVIQLSRKTFDTEYPKTKLTDWDFVVTTDISEMGANFRAGRVIDPRRCLKPVILTDGPERVILAGPIPVTPASAAQRRGRIGRNPAQEDDQYVFSGDPLKNDEDHAHWTEAKMLLDNIYTPEGIIPTLFGPEREKTQAIDGEFRLRGEQRKTFVELMRRGDLPVWLSYKVASAGISYKDREWCFTGERNNQILEENMEVEIWTREGEKKKLRPRWLDARVYADPMALKDFKEFASGRKSITLDILTEIASLPTYLSSRAKLALDNIVMLHTTERGGRAYQHALNELPESLETLMLVALLGAMTAGIFLFFMQGKGIGKLSMGLITIAVASGLLWVAEIQPQWIAASIILEFFLMVLLIPEPEKQRTPQDNQLIYVILTILTIIGLIAANEMGLIEKTKTDFGFYQVKTETTILDVDLRPASAWTLYAVATTILTPMLRHTIENTSANLSLAAIANQAAVLMGLGKGWPLHRMDLGVPLLAMGCYSQVNPTTLTASLVMLLVHYAIIGPGLQAKATREAQKRTAAGIMKNPTVDGITVIDLEPISYDPKFEKQLGQVMLLVLCAGQLLLMRTTWAFCEVLTLATGPILTLWEGNPGRFWNTTIAVSTANIFRGSYLAGAGLAFSLIKNAQTPRRGTGTTGETLGEKWKRQLNSLDRKEFEEYKRSGILEVDRTEAKSALKDGSKIKHAVSRGSSKIRWIVERGMVKPKGKVVDLGCGRGGWSYYMATLKNVTEVKGYTKGGPGHEEPIPMATYGWNLVKLHSGVDVFYKPTEQVDTLLCDIGESSSNPTIEEGRTLRVLKMVEPWLSSKPEFCIKVLNPYMPTVIEELEKLQRKHGGNLVRCPLSRNSTHEMYWVSGASGNIVSSVNTTSKMLLNRFTTRHRKPTYEKDVDLGAGTRSVSTETEKPDMTIIGRRLQRLQEEHKETWHYDQENPYRTWAYHGSYEAPSTGSASSMVNGVVKLLTKPWDVIPMVTQLAMTDTTPFGQQRVFKEKVDTRTPQPKPGTRMVMTTTANWLWALLGKKKNPRLCTREEFISKVRSNAAIGAVFQEEQGWTSASEAVNDSRFWELVDKERALHQEGKCESCVYNMMGKREKKLGEFGRAKGSRAIWYMWLGARFLEFEALGFLNEDHWFGRENSWSGVEGEGLHRLGYILEEIDKKDGDLMYADDTAGWDTRITEDDLQNEELITEQMAPHHKILAKAIFKLTYQNKVVKVLRPTPRGAVMDIISRKDQRGSGQVGTYGLNTFTNMEVQLIRQMEAEGVITQDDMQNPKGLKERVEKWLRECGVDRLKRMAISGDDCVVKPLDERFGTSLLFLNDMGKVRKDIPQWEPSKGWKNWQEVPFCSHHFHKIFMKDGRSLVVPCRNQDELIGRARISQGAGWSLRETACLGKAYAQMWSLMYFHRRDLRLASMAICSAVPTEWFPTSRTTWSIHAHHQWMTTEDMLKVWNRVWIEDNPNMIDKTPVHSWEDIPYLGKREDLWCGSLIGLSSRATWAKNIHTAITQVRNLIGKEEYVDYMPVMKRYSAPSESEGVL

SEQ ID NO: 5184 - protein, 3288 aa, Artificial Sequence
  derived and/or modified protein sequence (wt) from DENV-4__FJ882601__SS-prME
STITLLCLIPTVMAFHLSTRDGEPLMIVAKHERGRPLLFKTTEGINKCTLIAMDLGEMCEDTVTYKCPLLVNTEPEDIDCWCNLTSTWVMYGTCTQSGERRREKRSVALTPHSGMGLETRAETWMSSEGAWKHAQRVESWILRNPGFALLAGFMAYMIGQTGIQRTVFFVLMMLVAPSYGMRCVGVGNRDFVEGVSGGAWVDLVLEHGGCVTTMAQGKPTLDFELTKTTAKEVALLRTYCIEASISNITTATRCPTQGEPYLKEEQDQQYICRRDVVDRGWGNGCGLFGKGGVVTCAKFSCSGKITGNLVQIENLEYTVVVTVHNGDTHAVGNDTSNHGVTATITPRSPSVEVKLPDYGELTLDCEPRSGIDFNEMILMKMKKKTWLVHKQWFLDLPLPWTAGADTSEVHWNYKERMVTFKVPHAKRQDVTVLGSQEGAMHSALAGATEVDSGDGNHMFAGHLKCKVRMEKLRIKGMSYTMCSGKFSIDKEMAETQHGTTVVKVKYEGAGAPCKVPIEIRDVNKEKVVGRVISSTPLAENTNSVTNIELEPPFGDSYIVIGVGNSALTLHWFRKGSSIGKMFESTYRGAKRMAILGETAWDFGSVGGLFTSLGKAVHQVFGSVYTTMFGGVSWMIRILIGFLVLWIGTNSRNTSMAMTCIAVGGITLFLGFTVQADMGCVVSWSGRELKCGSGIFVVDNVHTWTEQYKFQPESPARLASAILNAHKDGVCGIRSTTRLENVMWKQITNELNYVLWEGGHDLTVVAGDVKGVLTKGKRALTPPVSDLKYSWKTWGKAKIFTPEARNSTFLIDGPDTSECPNERRAWNSLEVEDYGFGMFTTNIWMKFREGSSEVCDHRLMSAAIKDQKAVHADMGYWIESSKNQTWQIEKASLIEVKTCLWPKTHTLWSNGVLESQMLIPKSYAGPFSQHNYRQGYATQTVGPWHLGKLEIDFGECPGTTVTIQEDCDHRGPSLRTTTASGKLVTQWCCRSCTMPPLRFLGEDGCWYGMEIRPLSEKEENMVKSQVAAGQGTSETFSMGLLCLTLFVEECLRRRVTRKHMILAVVITLCAIILGGLTWMDLLRALIMLGDTMSGRIGGQTHLAIMAVFKMSPGYVLGVFLRKLTSRETALMVIGMAMTTTLSIPHDLMELIDGISLGLILLKIVTQFDNTQVGTLALSLTFIRSTMSLVMAWRTIMAVLFVVTLIPLCRTSCLQKQSHWVEITALILGAQALPVYLMTLMKGASRRSWPLNEGIMAVGLVSLLGSALLKNDVPLAGPMVAGGLLLAAYVMSGSSADLSLEKAANVQWDEMADITGSSPIIEVKQDEDGSFSIRDVEETNMITLLVKLALITVSGLYPLAIPVTMTLWYMWQVKTQRSGALWDVPSPAATQKAALSEGVYRIMQRGLFGKTQVGVGIHMEGVFHTMWHVTRGSVICHETGRLEPSWADVRNDMISYGGGWRLGDKWDKEEDVQVLAIEPGKNPKHVQTKPGLFKTLTGEIGAVTLDFKPGTSGSPIVNRKGKVIGLYGNGVVTKSGDYVSAITQAERIGEPDYEVDEDIFRKKRLTIMDLHPGAGKTKRILPSIVREALKRRLRTLILAPTRVVAAEMEEALRGLPIRYQTPAVKSEHTGREIVDLMCHATFTTRLLSSTRVPNYNLIVMDEAHFTDPSSVAARGYISTRVEMGEAAAIFMTATPPGATDPFPQSNSPIEDIEREIPERSWNTGFDWITDYQGKTVWFVPSIKAGNDIANCLRKSGKKVIQLSRKTFDTEYPKTKLTDWDFVVTTDISEMGANFRAGRVIDPRRCLKPVILTDGPERVILAGPIPVTPASAAQRRGRIGRNPAQEDDQYVFSGDPLKNDEDHAHWTEAKMLLDNIYTPEGIIPTLFGPEREKTQAIDGEFRLRGEQRKTFVELMRRGDLPVWLSYKVASAGISYKDREWCFTGERNNQILEENMEVEIWTREGEKKKLRPRWLDARVYADPMALKDFKEFASGRKSITLDILTEIASLPTYLSSRAKLALDNIVMLHTTERGGRAYQHALNELPESLETLMLVALLGAMTAGIFLFFMQGKGIGKLSMGLITIAVASGLLWVAEIQPQWIAASIILEFFLMVLLIPEPEKQRTPQDNQLIYVILAILTIIGLIAANEMGLIEKTKTDFGFYQEKTETTILDVDLRPASAWTLYAVATTILTPMLRHTIENTSANLSLTAIANQAAVLMGLGKGWPLHRMDLGVPLLAMGCYSQVNPTTLTASLVMLLVHYAIIGPGLQAKATREALKRTAAGIMKNPTVDGITVIDLEPISYDPKFEKQLGQVMLLVLCAGQLLLMRTTWAFCEVLTLATGPILTLWEGNPGRFWNTTIAVSTANIFRGSYLAGAGLAFSLIKNVQTPRRGTGTTGETLGEKWKRQLNSLDRKEFEEYKRSGILEVDRTEAKSALKDGSKIKHAVSRGSSKIRWIVERGMVKPKGKVVDLGCGRGGWSYYMATLKNVTEVKGYTKGGPGHEEPIPMATYGWNLVKLHSGVDVFYKPTEQVDTLLCDIGESSSNPTIEEGRTLRVLKMVEPWLSSKPEFCIKVLNPYMPTVIEELEKLQRKHGGNLVRCPLSRNSTHEMYWVSGASGNIVSSVNTTSKMLLNRFTTRHRKPTYEKDVDLGAGTRSVSTETEKPDMTIIGRRLQRLQEEHKETWHYDQENPYRTWAYHGSYEAPSTGSASSMVNGVVKLLTKPWDVIPMVTQLAMTDTTPFGQQRVFKEKVDTRTPQPKPGTRMVMTTTANWLWALLGKKKNPRLCTREEFISKVRSNAAIGAVFQEEQGWTSASEAVNDSRFWELVDKERALHQEGKCESCVYNMMGKREKKLGEFGRAKGSRAIWYMWLGARFLEFEALGFLNEDHWFGRENSWSGVEGEGLHRLGYILEEIDKKDGDLMYADDTAGWDTRITEDDLQNEELVTEQMAPHHKILAKAIFKLTYQNKVVKVLRPTPRGAVMDIISRKDQRGSGQVGTYGLNTFTNMEVQLIRQMEAEGVITQDDMQNPKGLKERVEKWLRECGVDRLKRMAISGDDCVVKPLDERFGTSLLFLNDMGKVRKDIPQWEPSKGWKNWQEVPFCSHHFHKIFMKDGRSLVVPCRNQDELIGRARISQGAGWSLRETACLGKAYAQMWSLMYFHRRDLRLASMAICSAVPTEWFPTSRTTWSIHAHHQWMTTEDMLKVWNRVWIEDNPNMIDKTPVHSWEDIPYLGKREDLWCGSLIGLSSRATWAKNIHTAITQVRNLIGKEEYVDYMPVMKRYSAPSESEGVL

SEQ ID NO: 5185 - protein, 3288 aa, Artificial Sequence
  derived and/or modified protein sequence (wt) from DENV-4__FJ226067__SS-prME
STITLLCLIPTVMAFHLSTRDGEPLMIVAKHERGRPLLFKTTEGINKCTLIAMDLGEMCEDTVTYKCPLLVNTEPEDIDCWCNLTSTWVMYGTCTQSGERRREKRSVALTPHSGMGLETRAETWMSSEGAWKHAQRVESWILRNPGFALLAGFMAYMIGQTGIQRTVFFVLMMLVAPSYGMRCVGVGNRDFVEGVSGGAWVDLVLEHGGCVTTMAQGKPTLDFELTKTTAKEVALLRTYCIEASISNITTATRCPTQGEPYLKEEQDQQYICRRDVVDRGWGNGCGLFGKGGVVTCAKFSCSGKITGNLVQIENLEYTVVVTVHNGDTHAVGNDTSNHGVTATITPRSPSVEVKLPDYGELTLDCEPRSGIDFNEMILMKMKKKTWLVHKQWFLDLPLPWTAGADTSEVHWNYKERMVTFKVPHAKRQDVTVLGSQEGAMHSALAGATEVDSGDGNHMFAGHLKCKVRMEKLRIKGMSYTMCSGKFSIDKEMAETQHGTTVVKVKYEGAGAPCKVPIEIRDVNKEKVVGRVISSTPLAENTNSVTNIELEPPFGDSYIVIGVGNSALTLHWFRRGSSIGKMFESTYRGAKRMAILGETAWDFGSVGGLFTSLGKAVHQVFGSVYTTMFGGVSWMIRILIGFLVLWIGTNSRNTSMAMTCITVGGITLFLGFTVQADMGCVVSWSGRELKCGSGIFVVDNVHTWTEQYKFQPESPARLASAILNAHKDGVCGIRSTTRLENVMWKQITNELNYALWEGGHDLTVVAGDVKGVLTKGKRALTPPVSDLKYSWKTWGKAKIFTPEARNSTFLIDGPDTSECPNERRAWNSLEVEDYGFGMFTTNIWMKFREGSSEVCDHRLMSAAIKDQKAVHADMGYWIESSKNQTWQIEKASLIEVKTCLWPKTHTLWSNGVLESQMLIPKSYAGPFSQHNYRQGYATQTVGPWHLGKLEIDFGECPGTTVTIQEDCDHRGPSLRTTTASGKLVTQWCCRSCTMPPLRFLGEDGCWYGMEIRPLSEKEENMVKSQVTAGQGTSETFSMGLLCLTLFVEECLRRRVTRKHMILVVVITLCAIILGGLTWMDLLRALIMLGDTMSGRIGGQIHLAIMAVFKMSPGYVLGVFLRKLTSRETALMVIGMAMTTVLSIPHDLMELIDGISLGLILLKIVTQFDNTQVGTLALSLTFIRSTMPLVMAWRTIMAVLFVVTLIPLCRTSCLQKQSHWVEITALILGAQALPVYLMTLMKGASRRSWPLNEGIMAVGLVSLLGSALLKNDVPLAGPMVAGGLLLAAYVMSGSSADLSLEKAANVQWDEMADITGSSPIIEVKQDEDGSFSIRDVEETNMITLLVKLALITVSGLYPLAIPVTMTLWYMWQVKTQRSGALWDVPSPAATQKAALSEGVYRIMQRGLFGKTQVGVGIHMEGVFHTMWHVTRGSVICHETGRLEPSWADVRNDMISYGGGWRLGDKWDKEEDVQVLAIEPGKNPKHVQTKPGLFKTLTGEIGAVTLDFKPGTSGSPIINRKGKVIGLYGNGVVTKSGDYVSAITQAERIGEPDYEVDEDIFRKKRLTIMDLHPGAGKTKRILPSIVREALKRRLRTLILAPTRVVAAEMEEALRGLPIRYQTPAVKSEHTGREIVDLMCHATFTTRLLSSTRVPNYNLIVMDEAHFTDPSSVAARGYISTRVEMGEAAAIFMTATPPGATDPFPQSNSPIEDIEREIPERSWNTGFDWITDYQGKTVWFVPSIKAGNDIANCLRKSGKKVIQLSRKTFDTEYPKTKLTDWDFVVTTDISEMGANFRAGRVIDPRRCLKPVILTDGPERVILAGPIPVTPASAAQRRGRIGRNPAQEDDQYVFSGDPLKNDEDHAHWTEAKMLLDNIYTPEGIIPTLFGPEREKTQAIDGEFRLRGEQRKTFVELMRRGDLPVWLSYKVASAGISYKDREWCFTGERNNQILEENMEVEIWTREGEKKKLRPRWLDARVYADPMALKDFKEFASGRKSITLDILTEIASLPTYLSSRAKLALDNIVMLHTTERGGRAYQHALNELPESLETLMLVALLGAMTAGIFLFFMQGKGIGKLSMGLIAIAVASGLLWVAEIQPQWIAASIILEFFLMVLLIPEPEKQRTPQDNQLIYVILTILTIIGLIAANEMGLIEKTKTDFGFYQVKTETTILDVDLRPASAWTLYAVATTILTPMLRHTIENTSANLSLAAIANQAAVLMGLGKGWPLHRMDLGVPLLAMGCYSQVNPTTLTASLVMLLVHYAIIGPGLQAKATREAQKRTAAGIMKNPTVDGITVIDLEPISYDPKFEKQLGQVMLLVLCAGQLLLMRTTWAFCEVLTLATGPILTLWEGNPGRFWNTTIAVSTANIFRGSYLAGAGLAFSLIKNAQTPRRGTGTTGETLGEKWKRQLNSLDRKEFEEYKRSGILEVDRTEAKSALKDGSKIKHAVSRGSSKIRWIVERGMVKPKGKVVDLGCGRGGWSYYMATLKNVTEVKGYTKGGPGHEEPIPMATYGWNLVKLHSGVDVFYKPTEQVDTLLCDIGESSSNPTIEEGRTLRVLKMVEPWLSSKPEFCIKVLNPYMPTVIEELEKLQRKHGGNLVRCPLSRNSTHEMYWVSGASGNIVSSVNTTSKMLLNRFTTRHRKPTYEKDVDLGAGTRSVSTETEKPDMTIIGRRLQRLQEEHKETWHYDQENPYRTWAYHGSYEAPSTGSASSMVNGVVKLLTKPWDVIPMVTQLAMTDTTPFGQQRVFKEKVDTRTPQPKPGTRMVMTTTANWLWALLGKKKNPRLCTREEFISKVRSNAAIGAVFQEEQGWTSASEAVNDSRFWELVDKERALHQEGKCESCVYNMMGKREKKLGEFGRAKGSRAIWYMWLGARFLEFEALGFLNEDHWFGRENSWSGVEGEGLHRLGYILEEIDKKDGDLMYADDTAGWDTRITEDDLQNEELITEQMAPHHKILAKAIFKLTYQNKVVKVLRPTPRGAVMDIISRKDQRGSGQVGTYGLNTFTNMEVQLIRQMEAEGVITQDDMQNPKGLKERVEKWLRECGVDRLKRMAISGDDCVVKPLDERFGTSLLFLNDMGKVRKDIPQWEPSKGWKNWQEVPFCSHHFHKIFMKDGRSLVVPCRNQDELIGRARISQGAGWSLRETACLGKAYAQMWSLMYFHRRDLRLASMAICSAVPTEWFPTSRTTWSIHAHHQWMTTEDMLKVWNRVWIEDNPNMTDKTPVHSWEDIPYLGKREDLWCGSLIGLSSRATWAKNIHTAITQVRNLIGKEEYVDYMPVMKRYSALSESEGVL

SEQ ID NO: 5186 - protein, 3288 aa, Artificial Sequence
  derived and/or modified protein sequence (wt) from DENV-4__EU854299__SS-prME
STITLLCLIPTVMAFHLSTRDGEPLMIVAKHERGRPLLFKTTEGINKCTLIAMDLGEMCEDTVTYKCPLLVNTEPEDIDCWCNLTSTWVMYGTCTQSGERRREKRSVALTPHSGMGLETRAETWMSSEGAWKHAQRVESWILRNPGFALLAGFMAYMIGQTGIQRTVFFVLMMLVAPSYGMRCVGVGNRDFVEGVSGGAWVDLVLEHGGCVTTMAQGKPTLDFELTKTTAKEVALLRTYCIEALISNITTATRCPTQGEPYLKEEQDQQYICRRDVVDRGWGNGCGLFGKGGVVTCAKFSCSGKITGNLVQIENLEYTVVVTVHNGDTHAVGNDTSNHGVTATITPRSPSVEVKLPDYGELTLDCEPRSGIDFNEMILMKMKKKTWLVHKQWFLDLPLPWTTGADTSEVHWNYKERMVTFKVPHAKRQDVTVLGSQEGAMHSALAGATEVDSGDGNHMFAGHLKCKVRMEKLRIKGMSYTMCSGKFSIDKEMAETQHGTTVVKVKYEGAGAPCKVPIEIRDVNKEKVVGRVISATPLAENTNSVTNIELEPPFGDSYIVIGVGNSALTLHWFRKGSSIGKMFESTYRGAKRMAILGETAWDFGSVGGLFTSLGKAVHQVFGSVYTTMFGGVSWMIRILIGFLVLWIGTNSRNTSMAMTCIAVGGITLFLGFTVQADMGCVVSWSGRELKCGSGIFVVDNVHTWTEQYKFQPESPARLASAILNAHKDGVCGIRSTTRLENVMWKQITNELNYVLWEGGHDLTVVAGDVKGVLTKGKRALTPPASDLKYSWKTWGKAKIFTPEARNSTFLIDGPDTSECPNERRAWNSFEVEDYGFGMFTTNIWMKFREGSSEVCDHRLMSAAIKDQKAVHADMGYWIESSKNQTWQIERASLIEVKTCLWPKTHTLWSNGVLESQMLIPKSYAGPFSQHNYRQGYATQTVGPWHLGKLEIDFGECPGTTVTIQENCDHRGPSLRTTTASGKLVTQWCCRSCTMPPLRFLGEDGCWYGMEIRPLSEKEENMVKSQVTAGQGTSETFSMGLLCLTLFVEECLRRRVTRKHMILAVVITLCAIILGGLTWMDLLRALIMLGDTMSGRIGGQTHLAIMAVFKMSPGYVLGVFLRKLTSRETALMVIGMAMTTTLSIPHDLMELIDGISLGLILLKIVTQFDNTQVGTLALSLTFIRSTMSLVMAWRTIMAVLFVVTLIPLCRTSCLQKQSHWVEITALILGAQALPVYLMTLMKGASRRSWPLNEGIMAVGLVSLLGSALLKNDVPLAGPMVAGGLLLAAYVMSGSSADLSLEKAANVQWDEMADITGSSPIIEVKQDEDGSFSIRDVEETNMITLLVKLALITVSGLYPLAIPITMTLWYMWQVKTQRSGALWDVPSPAATQKAALSEGVYRIMQRGLFGKTQVGVGIHMEGVFHTMWHVTRGSVICHETGRLEPSWADVRNDMISYGGGWRLGDKWDKEEDVQVLAIEPGKNPKHVQTKPGLFKTLTGEIGAVTLDFKPGTSGSPIINRKGKVIGLYGNGVVTKSGDYVSAITQAERIGEPDYEVDEDIFRKKRLTIMDLHPGAGKTKRILPSIVREALKRRLRTLILAPTRVVAAEMEEALRGLPIRYQTPAVKSEHTGREIVDLMCHATFTTRLLSSTRVPNYNLIVMDEAHFTDPSSVAARGYISTRVEMGEAAAIFMTATPPGATDPFPQSNSPIEDIEREIPERSWNTGFDWITDYQGKTVWFVPSIKAGNDIANCLRKSGKKVIQLSRKTFDTEYPKTKLTDWDFVVTTDISEMGANFRAGRVIDPRRCLKPVILTDGPERVILAGPIPVTPASAAQRRGRIGRNPAQEDDQYVFSGDPLKNDEDHAHWTEAKMLLDNIYTPEGIIPTLFGPEREKTQAIDGEFRLRGEQRKTFVELMRRGDLPVWLSYKVASAGISYKDREWCFTGERNNQILEENMEVEIWTREGEKKKLRPKWLDARVYADPMALKDFKEFASGRKSITLDILTEIASLPTYLSSRAKLALDNIVMLHTTERGGRAYQHALNELPESLETLMLVALLGAMTAGIFLFFMQGKGIGKLSMGLITIAVASGLLWVAEIQPQWIAASIILEFFLMVLLIPEPEKQRTPQDNQLIYVILTILTIIGLIAANEMGLIEKTKTDFGFYQVKTETTILDVDLRPASAWTLYAVATTILTPMLRHTIENTSANLSLAAIANQAAVLMGLGKGWPLHRMDLGVPLLAMGCYSQVNPTTLTASLVMLLVHYAIIGPGLQAKATREAQKRTAAGIMKNPTVDGITVIDLEPISYDPKFEKQLGQVMLLVLCAGQLLLMRTTWAFCEVLTLATGPILTLWEGNPGRFWNTTIAVSTANIFRGSYLAGAGLAFSLIKNAQTPRRGTGTTGETLGEKWKRQLNSLDRKEFEEYKRSGILEVDRTEAKSALKDGSKIKHAVSRGSSKIRWIVERGMVKPKGKVVDLGCGRGGWSYYMATLKNVTEVKGYTKGGPGHEEPIPMATYGWNLVKLHSGVDVFYKPTEQVDTLLCDIGESSSNPTIEEGRTLRVLKMVEPWLSSKPEFCIKVLNPYMPTVIEELEKLQRKHGGNLVRCPLSRNSTHEMYWVSGASGNIVSSVNTTSKMLLNRFTTRHRKPTYEKDVDLGAGTRSVSTETEKPDMTIIGRRLQRLQEEHKETWHYDQENPYRTWAYHGSYEAPSTGSASSMVNGVVKLLTKPWDVIPMVTQLAMTDTTPFGQQRVFKEKVDTRTPQPKPGTRMVMTTTANWLWALLGKKKNPRLCTREEFISKVRSNAAIGAVFQEEQGWTSASEAVNDSRFWELVDKERALHQEGKCESCVYNMMGKREKKLGEFGRAKGSRAIWYMWLGARFLEFEALGFLNEDHWFGRENSWSGVEGEGLHRLGYILEEIDKKDGDLMYADDTAGWDTRITEDDLQNEELITEQMAPHHKILAKAIFKLTYQNKVVKVLRPTPRGAVMDIISRKDQRGSGQVGTYGLNTFTNMEVQLIRQMEAEGVITQDDMQNPKGLKERVEKWLRECGVDRLKRMAISGDDCVVKPLDERFGTSLLFLNDMGKVRKDIPQWEPSKGWKNWQEVPFCSHHFHKIFMKDGRSLVVPCRNQDELIGRARISQGAGWSLRETACLGKAYAQMWSLMYFHRRDLRLASMAICSAVPTEWFPTSRTTWSIHAHHQWMTTEDMLKVWNRVWIEDNPNMIDKTPVHSWEDIPYLGKREDLWCGSLIGLSSRATWAKNIHTAITQVRNLIGKEEYVDYMPVMKRYSAPSESEGVL

SEQ ID NO: 5187 - protein, 3288 aa, Artificial Sequence
  derived and/or modified protein sequence (wt) from DENV-4__FJ182016__SS-prME
STITLLCLIPTVMAFHLSTRDGEPLMIVAKHERGRPLLFKTTEGINKCTLIAMDLGEMCEDTVTYKCPLLVNTEPEDIDCWCNLTSTWVMYGTCTQSGERRREKRSVALTPHSGMGLETRAETWMSSEGAWKHAQRVESWILRNPGFALLAGFMAYMIGQTGIQRTVFFVLMMLVAPSYGMRCVGVGNRDFVEGVSGGAWVDLVLEHGGCVTTMAQGKPTLDFELTKTTAKEVALLRTYCIEALISNITTATRCPTQGEPYLKEEQDQQYICRRDVVDRGWGNGCGLFGKGGVVTCAKFSCSGKITGNLVQIENLEYTVVVTVHNGDTHAVGNDTSNHGVTATITPRSPSVEVKLPDYGELTLDCEPRSGIDFNEMILMKMKKKTWLVHKQWFLDLPLPWTTGADTSEVHWNYKERMVTFKVPHAKRQDVTVLGSQEGAMHSALAGATEVDSGDGNHMFAGHLKCKVRMEKLRIKGMSYTMCSGKFSIDKEMAETQHGTTVVKVKYEGAGAPCKVPIEIRDVNKEKVVGRVISATPLAENTNSVTNIELEPPFGDSYIVIGVGNSALTLHWFRKGSSIGKMFESTYRGAKRMAILGETAWDFGSVGGLFTSLGKAVHQVFGSVYTTMFGGVSWMIRILIGFLVLWIGTNSRNTSMAMTCIAVGGITLFLGFTVQADMGCVVSWSGRELKCGSGIFVVDNVHTWTEQYKFQPESPARLASAILNAHKDGVCGIRSTTRLENVMWKQITNELNYVLWEGGHDLTVVAGDVKGVLTKGKRALTPPASDLKYSWKTWGKAKIFTPEARNSTFLIDGPDTSECPNERRAWNSFEVEDYGFGMFTTNIWMKFREGSSEVCDHRLMSAAIKDQKAVHADMGYWIESSKNQTWQIERASLIEVKTCLWPKTHTLWSNGVLESQMLIPKSYAGPFSQHNYRQGYATQTVGPWHLGKLEIDFGECPGTTVTIQENCDHRGPSLRTTTASGKLVTQWCCRSCTMPPLRFLGEDGCWYGMEIRPLSEKEENMVKSQVTAGQGTSETFSMGLLCLTLFVEECLRRRVTRKHMILAVVITLCAIILGGLTWMDLLRALIMLGDTMSGRIGGQTHLAIMAVFKMSPGYVLGVFLRKLTSRETALMVIGMAMTTTLSIPHDLMELIDGISLGLILLKIVTQFDNTQVGTLALSLTFIRSTMSLVMAWRTIMAVLFVVTLIPLCRTSCLQKQSHWVEITALILGAQALPVYLMTLMKGASRRSWPLNEGIMAVGLVSLLGSALLKNDVPLAGPMVAGGLLLAAYVMSGSSADLSLEKAANVQWDEMADITGSSPIIEVKQDEDGSFSIRDVEETNMITLLVKLALITVSGLYPLAIPITMTLWYMWQVKTQRSGALWDVPSPAATQKAALSEGVYRIMQRGLFGKTQVGVGIHMEGVFHTMWHVTRGSVICHETGRLEPSWADVRNDMISYGGGWRLGDKWDKEEDVQVLAIEPGKNPKHVQTKPGLFKTLTGEIGAVTLDFKPGTSGSPIINRKGKVIGLYGNGVVTKSGDYVSAITQAERIGEPDYEVDEDIFRKKRLTIMDLHPGAGKTKRILPSIVREALKRRLRTLILAPTRVVAAEMEEALRGLPIRYQTPAVKSEHTGREIVDLMCHATFTTRLLSSTRVPNYNLIVMDEAHFTDPSSVAARGYISTRVEMGEAAAIFMTATPPGATDPFPQSNSPIEDIEREIPERSWNTGFDWITDYQGKTVWFVPSIKAGNDIANCLRKSGKKVIQLSRKTFDTEYPKTKLTDWDFVVTTDISEMGANFRAGRVIDPRRCLKPVILTDGPERVILAGPIPVTPASAAQRRGRIGRNPAQEDDQYVFSGDPLKNDEDHAHWTEAKMLLDNIYTPEGIIPTLFGPEREKTQAIDGEFRLRGEQRKTFVELMRRGDLPVWLSYKVASAGISYKDREWCFTGERNNQILEENMEVEIWTREGEKKKLRPKWLDARVYADPMALKDFKEFASGRKSITLDILTEIASLPTYLSSRAKLALDNIVMLHTTERGGRAYQHALNELPESLETLMLVALLGAMTAGIFLFFMQGKGIGKLSMGLITIAVASGLLWVAEIQPQWIAASIILEFFLMVLLIPEPEKQRTPQDNQLIYVILTILTIIGLIAANEMGLIEKTKTDFGFYQVKTETTILDVDLRPASAWTLYAVATTILTPMLRHTIENTSANLSLAAIANQAAVLMGLGKGWPLHRMDLGVPLLAMGCYSQVNPTTLTASLVMLLVHYAIIGPGLQAKATREAQKRTAAGIMKNPTVDGITVIDLEPISYDPKFEKQLGQVMLLVLCAGQLLLMRTTWAFCEVLTLATGPILTLWEGNPGRFWNTTIAVSTANIFRGSYLAGAGLAFSLIKNAQTPRRGTGTTGETLGEKWKRQLNSLDRKEFEEYKRSGILEVDRTEAKSALKDGSKIKHAVSRGSSKIRWIVERGMVKPKGKVVDLGCGRGGWSYYMATLKNVTEVRGYTKGGPGHEEPIPMATYGWNLVKLHSGVDVFYKPTEQVDTLLCDIGESSSNPTIEEGRTLRVLKMVEPWLSSKPEFCIKVLNPYMPTVIEELEKLQRKHGGNLVRCPLSRNSTHEMYWVSGASGNIVSSVNTTSKMLLNRFTTRHRKPTYEKDVDLGAGTRSVSTETEKPDMTIIGRRLQRLQEEHKETWHYDQENPYRTWAYHGSYEAPSTGSASSMVNGVVKLLTKPWDVIPMVTQLAMTDTTPFGQQRVFKEKVDTRTPQPKPGTRMVMTTTANWLWALLGKKKNPRLCTREEFISKVRSNAAIGAVFQEEQGWTSASEAVNDSRFWELVDKERALHQEGKCESCVYNMMGKREKKLGEFGRAKGSRAIWYMWLGARFLEFEALGFLNEDHWFGRENSWSGVEGEGLHRLGYILEEIDKKDGDLMYADDTAGWDTRITEDDLQNEELITEQMAPHHKILAKAIFKLTYQNKVVKVLRPTPRGAVMDIISRKDQRGSGQVGTYGLNTFTNMEVQLIRQMEAEGVITQDDMQNPKGLKERVEKWLRECGVDRLKRMAISGDDCVVKPLDERFGTSLLFLNDMGKVRKDIPQWEPSKGWKNWQEVPFCSHHFHRIFMKDGRSLVVPCRNQDELIGRARISQGAGWSLRETACLGKAYAQMWSLMYFHRRDLRLASMAICSAVPTEWFPTSRTTWSIHAHHQWMTTEDMLKVWNRVWIEDNPNMIDKTPVHSWEDIPYLGKREDLWCGSLIGLSSRATWAKNIHTAITQVRNLIGKEEYVDYMPVMKRYSAPSESEGVL

SEQ ID NO: 5188 - protein, 3288 aa, Artificial Sequence
  derived and/or modified protein sequence (wt) from DENV-4__EU854300__SS-prME
STITLLCLIPTVMAFHLSTRDGEPLMIVAKHERGRPLLFKTTEGINKCTLIAMDLGEMCEDTVTYKCPLLVNTEPEDIDCWCNLTSTWVMYGTCTQSGERRREKRSVALTPHSGMGLETRAETWMSSEGAWKHAQRVESWILRNPGFALLAGFMAYMIGQTGIQRTVFFVLMMLVAPSYGMRCVGVGNRDFVEGVSGGAWVDLVLEHGGCVTTMAQGKPTLDFELTKTTAKEVALLRTYCIEALISNITTATRCPTQGEPYLKEEQDQQYICRRDVVDRGWGNGCGLFGKGGVVTCAKFSCSGKITGNLVQIENLEYTVVVTVHNGDTHAVGNDTSNHGVTATITPRSPSVEVKLPDYGELTLDCEPRSGIDFNEMILMKMKKKTWLVHKQWFLDLPLPWTTGADTSEVHWNYKERMVTFKVPHAKRQDVTVLGSQEGAMHSALAGATEVDSGDGNHMFAGHLKCKVRMEKLRIKGMSYTMCSGKFSIDKEMAETQHGTTVVKVKYEGAGAPCKVPIEIRDVNKEKVVGRVISATPLAENTNSVTNIELEPPFGDSYIVIGVGNSALTLHWFRKGSSIGKMFESTYRGAKRMAILGETAWDFGSVGGLFTSLGKAVHQVFGSVYTTMFGGVSWMIRILIGFLVLWIGTNSRNTSMAMTCIAVGGITLFLGFTVQADMGCVVSWNGRELKCGSGIFVVDNVHTWTEQYKFQPESPARLASAILNAHKDGVCGIRSTTRLENVMWKQITNELNYVLWEGGHDLTVVAGDVKGVLTKGKRALTPPASDLKYSWKTWGKAKIFTPETRNSTFLIDGPDTSECPNERRAWNSFEVEDYGFGMFTTNIWMKFREGSSEVCDHRLMSAAIKDQKAVHADMGYWIESSKNQTWQIERASLIEVKTCLWPKTHTLWSNGVLESQMLIPKSYAGPFSQHNYRQGYATQTVGPWHLGKLEIDFGECPGTTVTIQENCDHRGPSLRTTTASGKLVTQWCCRSCTMPPLRFLGEDGCWYGMEIRPLSEKEENMVKSQVTAGQGTSETFSMGLLCLTLFVEECLRRRVTRKHMILAVVITLCAIILGGLTWMDLLRALIMLGDTMSGRIGGQTHLAIMAVFKMSPGYVLGVFLRKLTSRETALMVIGMAMTTTLSIPHDLMELIDGISLGLILLKIVTQFDNTQVGTLALSLTFIRSTMSLVMAWRTIMAVLFVVTLIPLCRTSCLQKQSHWVEITALILGAQALPVYLMTLMKGASRRSWPLNEGIMAVGLVSLLGSALLKNDVPLAGPMVAGGLLLAAYVMSGSSADLSLEKAANVQWDEMADITGSSPIIEVKQDEDGSFSIRDVEETNMITLLVKLALITVSGLYPLAIPITMTLWYMWQVKTQRSGALWDVPSPAATQKAALSEGVYRIMQRGLFGKTQVGVGIHIEGVFHTMWHVTRGSVICHETGRLEPSWADVRNDMISYGGGWRLGDKWDKEEDVQVLAIEPGKNPKHVQTKPGLFKTLTGEIGAVTLDFKPGTSGSPIINRKGKVIGLYGNGVVTKSGDYVSAITQAERIGEPDYEVDEDIFRKKRLTIMDLHPGAGKTKRILPSIVREALKRRLRTLILAPTRVVAAEMEEALRGLPIRYQTPAVKSEHTGREIVDLMCHATFTTRLLSSTRVPNYNLIVMDEAHFTDPSSVAARGYISTRVEMGEAAAIFMTATPPGATDPFPQSNSPIEDIEREIPERSWNTGFDWITDYQGKTVWFVPSIKAGNDIANCLRKSGKKVIQLSRKTFDTEYPKTKLTDWDFVVTTDISEMGANFRAGRVIDPRRCLKPVILTDGPERVILAGPIPVTPASAAQRRGRIGRNLAQEDDQYVFSGDPLKNDEDHAHWTEAKMLLDNIYTPEGIIPTLFGPEREKTQAIDGEFRLRGEQRKTFVELMRRGDLPVWLSYKVASAGISYKDREWCFTGERNNQILEENMEVEIWTREGEKKKLRPKWLDARVYADPMALKDFKEFASGRKSITLDILTEIASLPTYLSSRAKLALDNIVMLHTTERGGRAYQHALNELPESLETLMLVALLGAMTAGIFLFFMQGKGIGKLSMGLITIAVASGLLWVAEIQPQWIAASIILEFFLMVLLIPEPEKQRTPQDNQLIYVILTILTIIGLIAANEMGLIEKTKADFGFYQVKTETTILDVDLRPASAWTLYAVATTILTPMLRHTIENTSANLSLAAIANQAAVLMGLGKGWPLHRMDLGVPLLAMGCYSQVNPTTLTASLVMLLVHYAIIGPGLQAKATREAQKRTAAGIMKNPTVDGITVIDLEPISYDPKFEKQLGQVMLLVLCAGQLLLMRTTWAFCEVLTLATGPILTLWEGNPGRFWNTTIAVSTANIFRGSYLAGAGLAFSLIKNAQTPRRGTGTTGETLGEKWKRQLNSLDRKEFEEYKRSGILEVDRTEAKSALKDGSKIKHAVSRGSSKIRWIVERGMVKPKGKVVDLGCGRGGWSYYMATLKNVTEVKGYTKGGPGHEEPIPMATYGWNLVKLHSGVDVFYKPTEQVDTLLCDIGESSSNPTIEEGRTLRVLKMVEPWLSSKPEFCIKVLNPYMPTVIEELEKLQRKHGGNLVRCPLSRNSTHEMYWVSGASGNIVSSVNTTSKMLLNRFTTRHRKPTYEKDVDLGAGTRSVSTETEKPDMTIIGRRLQRLQEEHKETWHYDQENPYRTWAYHGSYEAPSTGSASSMVNGVVKLLTKPWDVIPMVTQLAMTDTTPFGQQRVFKEKVDTRTPQPKPGTRMVMTTTANWLWALLGKKKNPRLCTREEFISKVRSNAAIGAVFQEEQGWTSASEAVNDSRFWELVDKERALHQEGKCESCVYNMMGKREKKLGEFGRAKGSRAIWYMWLGARFLEFEALGFLNEDHWFGRENSWSGVEGEGLHRLGYILEEIDKKDGDLMYADDTAGWDTRITEDDLQNEELITEQMAPHHKILAKAIFKLTYQNKVVKVLRPTPRGAVMDIISRKDQRGSGQVGTYGLNTFTNMEVQLIRQMEAEGVITQDDMQNPKGLKERVEKWLRECGVDRLKRMAISGDDCVVKPLDERFGTSLLFLNDMGKVRKDIPQWEPSKGWKNWQEVPFCSHHFHKIFMKDGRSLVVPCRNQDELIGRARISQGAGWSLRETACLGKAYAQMWSLMYFHRRDLRLASMAICSAVPTEWFPTSRTTWSIHAHHQWMTTEDMLKVWNRVWIEDNPNMIDKTPVHSWEDIPYLGKREDLWCGSLIGLSSRATWAKNIHTAITQVRNLIGKEEYVDYMPVMKRYSAPSESEGVL

SEQ ID NO: 5189 - protein, 3288 aa, Artificial Sequence
  derived and/or modified protein sequence (wt) from DENV-4__FJ182017__SS-prME
STITLLCLIPTVMAFHLSTRDGEPLMIVAKHERGRPLLFKTTEGINKCTLIAMDLGEMCEDTVTYKCPLLVNTEPEDIDCWCNLTSAWVMYGTCTQSGERRREKRSVALTPHSGMGLETRAETWMSSEGAWKHAQRVESWILRNPGFALLAGFMAYMIGQTGIQRTVFFVLMMLVAPSYGMRCVGVGNRDFVEGVSGGAWVDLVLEHGGCVTTMAQGKPTLDFELTKTTAKEVALLRTYCIEALISNITTATRCPTQGEPYLKEEQDQQYICRRDVVDRGWGNGCGLFGKGGVVTCAKFSCSGKITGNLVQIENLEYTVVVTVHNGDTHAVGNDTSNHGVTATITPRSPSVEVKLPDYGELTLDCEPRSGIDFNEMILMKMKKKTWLVHKQWFLDLPLPWTTGADTSEVHWNYKERMVTFKVPHAKRQDVTVLGSQEGAMHSALAGATEVDSGDGNHMFAGHLKCKVRMEKLRIKGMSYTMCSGKFSIDKEMAETQHGTTVVKVKYEGAGAPCKVPIEIRDVNKEKVVGRVISATPLAENTNSVTNIELEPPFGDSYIVIGVGNSALTLHWFRKGSSIGKMFESTYRGAKRMAILGETAWDFGSVGGLFTSLGKAVHQVFGSVYTTMFGGVSWMIRILIGFLVLWIGTNSRNTSMAMTCIAVGGITLFLGFTVQADMGCVVSWSGRELKCGSGIFVVDNVHTWTEQYKFQPESPARLASAILNAHKDGVCGIRSTTRLENVMWKQITNELNYVLWEGGHDLTVVAGDVKGVLTKGKRALTPPASDLKYSWKTWGKAKIFTPEARNSTFLIDGPDTSECPNERRAWNSFEVEDYGFGMFTTNIWMKFREGSSEVCDHRLMSAAIKDQKAVHADMGYWIESSKNQTWQIERASLIEVKTCLWPKTHTLWSNGVLESQMLIPKSYAGPFSQHNYRQGYATQTVGPWHLGKLEIDFGECPGTTVTIQENCDHRGPSLRTTTASGKLVTQWCCRSCTMPPLRFLGEDGCWYGMEIRPLSEKEENMVKSQVTAGQGTSETFSMGLLCLTLFVEECLRRRVTRKHMILAVVITLCAIILGGLTWMDLLRALIMLGDTMSGRIGGQTHLAIMAVFKMSPGYVLGVFLRKLTSRETALMVIGMAMTTTLSIPHDLMELIDGISLGLILLKIVTQFDNTQVGTLALSLTFIRSTMSLVMAWRTIMAVLFVVTLIPLCRTSCLQKQSHWVEITALILGAQALPVYLMTLMKGASRRSWPLNEGIMAVGLVSLLGSALLKNDVPLAGPMVAGGLLLAAYVMSGSSADLSLEKAANVQWDEMADITGSSPIIEVKQDEDGSFSIRDVEETNMITLLVKLALITVSGLYPLAIPITMTLWYMWQVKTQRSGALWDVPSPAATQKAALSEGVYRIMQRGLFGKTQVGVGIHMEGVFHTMWHVTRGSVICHETGRLEPSWADVRNDMISYGGGWRLGDKWDKEEDVQVLAIEPGKNPKHVQTKPGLFKTLTGEIGAVTLDFKPGTSGSPIINRKGKVIGLYGNGVVTKSGDYVSAITQAERIGEPDYEVDEDIFRKKRLTIMDLHPGAGKTKRILPSIVREALKRRLRTLILAPTRVVAAEMEEALRGLPIRYQTPAVKSEHTGREIVDLMCHATFTTRLLSSTRVPNYNLIVMDEAHFTDPSSVAARGYISTRVEMGEAAAIFMTATPPGATDPFPQSNSPIEDIEREIPERSWNTGFDWITDYQGKTVWFVPSIKAGNDIANCLRKSGKKVIQLSRKTFDTEYPKTKLTDWDFVVTTDISEMGANFRAGRVIDPRRCLKPVILTDGPERVILAGPIPVTPASAAQRRGRIGRNPAQEDDQYVFSGDPLKNDEDHAHWTEAKMLLDNIYTPEGIIPTLFGPEREKTQAIDGEFRLRGEQRKTFVELMRRGDLPVWLSYKVASAGISYKDREWCFTGERNNQILEENMEVEIWTREGEKKKLRPKWLDARVYADPMALKDFKEFASGRKSITLDILTEIASLPTYLSSRAKLALDNIVMLHTTERGGRAYQHALNELPESLETLMLVALLGAMTAGIFLFFMQGKGIGKLSMGLITIAVASGLLWVAEIQPQWIAASIILEFFLMVLLIPEPEKQRTPQDNQLIYVILTILTIIGLIAANEMGLIEKTKTDFGFYQVKTETTILDVDLRPASAWTLYAVATTILTPMLRHTIENTSANLSLAAIANQAAVLMGLGKGWPLHRMDLGVPLLAMGCYSQVNPTTLTASLVMLLVHYAIIGPGLQAKATREAQKRTAAGIMKNPTVDGITVIDLEPISYDPKFEKQLGQVMLLALCAGQLLLMRTTWAFCEVLTLATGPILTLWEGNPGRFWNTTIAVSTANIFRGSYLAGAGLAFSLIKNAQTPRRGTGTTGETLGEKWKRQLNSLDRKEFEEYKRSGILEVDRTEAKSALKDGSKIKHAVSRGSSKIRWIVERGMVKPKGKVVDLGCGRGGWSYYMATLKNVTEVKGYTKGGPGHEEPIPMATYGWNLVKLHSGVDVFYKPTEQVDTLLCDIGESSSNPTIEEGRTLRVLKMVEPWLSSKPEFCIKVLNPYMPTVIEELEKLQRKHGGNLVRCPLSRNSTHEMYWVSGASGNIVSSVNTTSKMLLNRFTTRHRKPTYEKDVDLGAGTRSVSTETEKPDMTIIGRRLQRLQEEHKETWHYDQENPYRTWAYHGSYEAPSTGSASSMVNGVVKLLTKPWDVIPMVTQLAMTDTTPFGQQRVFKEKVDTRTPQPKPGTRMVMTTTANWLWALLGKKKNPRLCTREEFISKVRSNAAIGAVFQEEQGWTSASEAVNDSRFWELVDKERALHQEGKCESCVYNMMGKREKKLGEFGRAKGSRAIWYMWLGARFLEFEALGFLNEDHWFGRENSWSGVEGEGLHRLGYILEEIDKKDGDLMYADDTAGWDTRITEDDLQNEELITEQMAPHHKILAKAIFKLTYQNKVVKVLRPTPRGAVMDIISRKDQRGSGQVGTYGLNTFTNMEVQLIRQMEAEGVITQDDMQNPKGLKERVEKWLRECGVDRLKRMAISGDDCVVKPLDERFGTSLLFLNDMGKVRKDIPQWEPSKGWKNWQEVPFCSHHFHKIFMKDGRSLVVPCRNQDELIGRARISQGAGWSLRETACLGKAYAQMWSLMYFHRRDLRLASMAICSAVPTEWFPTSRTTWSIHAHHQWMTTEDMLKVWNRVWIEDNPNMIDKTPVHSWEDIPYLGKREDLWCGSLIGLSSRATWAKNIHTAITQVRNLIGKEEYVDYMPVMKRYSAPSESEGVL

SEQ ID NO: 5190 - protein, 3288 aa, Artificial Sequence
  derived and/or modified protein sequence (wt) from DENV-4__EU854301__SS-prME
STITLLCLIPTVMAFHLSTRDGEPLMIVAKHERGRPLLFKTTEGINKCTLIAMDLGEMCEDTVTYKCPLLVNTEPEDIDCWCNLTSTWVMYGTCTQSGERRREKRSVALTPHSGMGLETRAETWMSSEGAWKHAQRVESWILRNPGFALLAGFMAYMIGQTGIQRTVFFVLMMLVAPSYGMRCVGVGNRDFVEGVSGGAWVDLVLEHGGCVTTMAQGKPTLDFELTKTTAKEVALLRTYCIEASISNITTATRCPTQGEPYLKEEQDQQYICRRDVVDRGWGNGCGLFGKGGVVTCAKFSCSGKITGNLVQIENLEYTVVVTVHNGDTHAVGNDTSNHGVTATITPRSPSVEVKLPDYGELTLDCEPRSGIDFNEMILMKMKKKTWLVHKQWFLDLPLPWTTGADTSEVHWNYKERMVTFKVPHAKRQDVTVLGSQEGAMHSALAGATEVDSGDGNHMFAGHLKCKVRMEKLRIKGMSYTMCSGKFSIDKEMAETQHGTTVVKVKYEGAGAPCKVPIEIRDVNKEKVVGRVISATPLAENTNSVTNIELEPPFGDSYIVIGVGNSALTLHWFRKGSSIGKMFESTYRGAKRMAILGETAWDFGSVGGLFTSLGKAVHQIFGSVYTTMFGGVSWMIRILIGFLVLWIGTNSRNTSMAMTCIAVGGITLFLGFTVQADMGCVVSWSGRELKCGSGIFVVDNVHTWTEQYKFQPESPARLASAILNAHKDGVCGIRSTTRLENVMWKQITNELNYVLWEGGHDLTVVAGDVKGVLTKGKRALTPPASDLKYSWKTWGKAKIFTPEARNSTFLIDGPDTSECPNERRAWNSFEVEDYGFGMFTTNIWMKFREGSSEVCDHRLMSAAIKDQKAVHADMGYWIESSKNQTWQIERASLIEVKTCLWPKTHTLWSNGVLESQMLIPKSYAGPFSQHNYRQGYATQTVGPWHLGKLEIDFGECPGTTVTIQENCDHRGPSLRTTTASGKLVTQWCCRSCTMPPLRFLGEDGCWYGMEIRPLSEKEENMVKSQVTAGQGTSETFSMGLLCLTLFVEECLRRRVTRKHMILAVVITLCAIILGGLTWMDLLRALIMLGDTMSGRIGGQTHLAIMAVFKMSPGYVLGVFLRKLTSRETALMVIGMAMTTTLSIPHDLMELIDGISLGLILLKIVTQFDNTQVGTLALSLTFIRSTMSLVMAWRTIMAVLFVVTLIPLCRTSCLQKQSHWVEITALILGAQALPVYLMTLMKGASRRSWPLNEGIMAVGLVSLLGSALLKNDVPLAGPMVAGGLLLAAYVMSGSSADLSLEKAANVQWDEMADITGSSPIIEVKQDEDGSFSIRDVEETNMITLLVKLALITVSGLYPLAIPITMTLWYMWQVKTQRSGALWDVPSPAATQKAALSEGVYRIMQRGLFGKTQVGVGIHMEGVFHTMWHVTRGSVICHETGRLEPSWADVRNDMISYGGGWRLGDKWDKEEDVQVLAIEPGKNPKHVQTKPGLFKTLTGEIGAVTLDFKPGTSGSPIINRKGKVIGLYGNGVVTKSGDYVSAITQAERIGEPDYEVDEDIFRKKRLTIMDLHPGAGKTKRILPSIVREALKRRLRTLILAPTRVVAAEMEEALRGLPIRYQTPAVKSEHTGREIVDLMCHATFTTRLLSSTRVPNYNLIVMDEAHFTDPSSVAARGYISTRVEMGEAAAIFMTATPPGATDPFPQSNSPIEDIEREIPERSWNTGFDWITDYQGKTVWFVPSIKAGNDIANCLRKSGKKVIQLSRKTFDTEYPKTKLTDWDFVVTTDISEMGANFRAGRVIDPRRCLKPVILTDGPERVILAGPIPVTPASAAQRRGRIGRNPAQEDDQYVFSGDPLKNDEDHAHWTEAKMLLDNIYTPEGIIPTLFGPEREKTQAIDGEFRLRGEQRKTFVELMRRGDLPVWLSYKVASAGISYKDREWCFTGERNNQILEENMEVEIWTREGEKKKLRPKWLDARVYADPMALKDFKEFASGRKSITLDILTEIASLPTYLSSRAKLALDNIVMLHTTERGGRAYQHALNELPESLETLMLVALLGAMTAGIFLFFMQGKGMGKLSMGLITIAVASGLLWVAEIQPQWIAASIILEFFLMVLLIPEPEKQRTPQDNQLIYVILTILTIIGLIAANEMGLIEKTKTDFGFYQVKTETTILDVDLRPASAWTLYAVATTILTPMLRHTIENTSANLSLAAIANQAAVLMGLGKGWPLHRMDLGVPLLAMGCYSQVNPTTLTASLVMLLVHYAIIGPGLQAKATREAQKRTAAGIMKNPTVDGITVIDLEPISYDPKFEKQLGQVMLLVLCAGQLFLMRTTWAFCEVLTLATGPILTLWEGNPGRFWNTTIAVSTANIFRGSYLAGAGLAFSLIKNAQTPRRGTGTTGETLGEKWKRQLNSLDRKEFEEYKRSGILEVDRTEAKSALKDGSKIKHAVSRGSSKIRWIVERGMVKPKGKVVDLGCGRGGWSYYMATLKNVTEVKGYTKGGPGHEEPIPMATYGWNLVKLHSGVDVFYKPTEQVDTLLCDIGESSSNPTIEEGRTLRVLKMVEPWLSSKPEFCIKVLNPYMPTVIEELEKLQRKHGGNLVRCPLSRNSTHEMYWVSGASGNIVSSVNTTSKMLLNRFTTRHRKPTYEKDVDLGAGTRSVSTETEKPDMTIIGRRLQRLQEEHKETWHYDQENPYRTWAYHGSYEAPSTGSASSMVNGVVKLLTKPWDVIPMVTQLAMTDTTPFGQQRVFKEKVDTRTPQPKPGTRMVMTTTANWLWALLGKKKNPRLCTREEFISKVRSNAAIGAVFQEEQGWTSASEAVNDSRFWELVDKERALHQEGKCESCVYNMMGKREKKLGEFGRAKGSRAIWYMWLGARFLEFEALGFLNEDHWFGRENSWSGVEGEGLHRLGYILEEIDKKDGDLMYADDTAGWDTRITEDDLQNEELITEQMAPHHKILAKAIFKLTYQNKVVKVLRPTPRGAVMDIISRKDQRGSGQVGTYGLNTFTNMEVQLIRQMEAEGVITQDDMQNPKGLKERVEKWLRECGVDRLKRMAISGDDCVVKPLDERFGTSLLFLNDMGKVRKDIPQWEPSKGWKNWQEVPFCSHHFHKIFMKDGRSLVVPCRNQDELIGRARISQGAGWSLRETACLGKAYAQMWSLMYFHRRDLRLASMAICSAVPTEWFPTSRTTWSIHAHHQWMTTEDMLKVWNRVWIEDNPNMIDKTPVHSWEDIPYLGKREDLWCGSLIGLSSRATWAKNIHTAITQVRNLIGKEEYVDYMPAMKRYSAPSESEGVL

SEQ ID NO: 5191 - protein, 3288 aa, Artificial Sequence
  derived and/or modified protein sequence (wt) from DENV-4__FJ639736__SS-prME
STMTLLCLIPTAMAFHLSTRDGEPLMIVAKHERGRPLLFKTTEGINKCTLIAMDLGEMCEDTVTYKCPLLVNTEPEDIDCWCNLTSTWVMYGTCTQSGERRREKRSVALTPHSGMGLETRAETWMSSEGAWKHAQRVESWILRNPGFALLAGFMAYMIGQTGIQRTVFFVLMMLVAPSYGMRCVGVGNRDFVEGVSGGAWVDLVLEHGGCVTTMAQGKPTLDFELTKTTAKEVALLRTYCIEALISNITTATRCPTQGEPYLKEEQDQQYICRRDVVDRGWGNGCGLFGKGGVVTCAKFSCSGKITGNLVQIENLEYTVVVTVHNGDTHAVGNDTSNHGVTATITPRSPSVEVKLPDYGELTLDCEPRSGIDFNEMILMKMKKKTWLVHKQWFLDLPLPWTAGADTSEVHWNYKERMVTFKVPHAKRQDVTVLGSQEGAMHSALAGATEVDSGDGNHMFAGHLKCKVRMEKLRIKGMSYTMCSGKFSIDKEMAETQHGTTVVKVKYEGAGAPCKVPIEIRDVNKEKVVGRVISSTPLAENTNSVTNIELEPPFGDSYIVIGVGNSALTLHWFRKGSSIGKMFESTYRGAKRMAILGETAWDFGSVGGLFTSLGKAVHQVFGSVYTTMFGGVSWMIRILIGFLVLWIGTNSRNTSMAMTCIAVGGITLFLGFTVQADMGCVVSWSGRELKCGSGIFVVDNVHTWTEQYKFQPESPARLASAILNAHKDGVCGIRSTTRLENVMWKQITNELNYVLWEGGHDLTVVAGDVKGVLTKGKRALTPPVSDLKYSWKTWGKAKIFTPEARNSTFLIDGPDTSECPNERRAWNSLEVEDYGFGMFTTNIWMKFREGSSEVCDHRLMSAAIKDQKAVHADMGYWIESSKNQTWQIERASLIEVKTCLWPKTHTLWSNGVLESQMLIPKSYAGPFSQHNYRQGYATQTVGPWHLGKLEIDFGECPGTTVTIQEDCDHRGPSLRTTTASGKLVTQWCCRSCTMPPLRFLGEDGCWYGMEIRPLSEKEENMVKSQVTAGQGTSETFSMGLLCLTLFVEECLRRRVTRKHMILAVVITLCAIILGGLTWMDLLRALIMLGDTMSGRIGGQTHLAIMAVFKMSPGYVLGVFLRKLTSRETALMVIGMAMTTTLSIPHDLMELIDGISLGLILLKIVTQFDNTQVGTLALSLTFIRSTMSLVMAWRTIMAVLFVVTLIPLCRTSCLQKQSHWVEITALILGAQALPVYLMTLMKGASRRSWPLNEGIMAVGLVSLLGSALLKNDVPLAGPMVAGGLLLAAYVMSGSSADLSLEKAANVQWDEMADITGSSPIIEVKQDEDGSFSIRDVEETNMITLLVKLALITVSGLYPLAIPVTMTLWYMWQVKTQRSGALWDVPSPAATQKAALSEGVYRIMQRGLFGKTQVGVGIHMEGVFHTMWHVTRGSVICHETGRLEPSWADVRNDMISYGGGWRLGDKWDKEEDVQVLAIEPGKNPKHVQTKPGLFKTLTGEIGAVTLDFKPGTSGSPIINRKGKVIGLYGNGVVTKSGDYVSAITQAERIGEPDYEVDEDIFRKKRLTIMDLHPGAGKTKRILPSIVREALKRRLRTLILAPTRVVAAEMEEALRGLPIRYQTPAVKSEHTGREIVDLMCHATFTTRLLSSTRVPNYNLIVMDEAHFTDPSSVAARGYISTRVEMGEAAAIFMTATPPGATDPFPQSNSPIEDIEREIPERSWNTGFDWITDYQGKTVWFVPSIKAGNDIANCLRKSGKKVIQLSRKTFDTEYPKTKLTDWDFVVTTDISEMGANFRAGRVIDPRRCLKPVILTDGPERVILAGPIPVTPASAAQRRGRIGRNPAQEDDQYVFSGDPLKNDEDHAHWTEAKMLLDNIYTPEGIIPTLFGPEREKTQAIDGEFRLRGEQRKTFVELMRRGDLPVWLSYKVASAGISYKDREWCFTGERNNQILEENMEVEIWTREGEKKKLRPRWLDARVYADPMALKDFKEFASGRKSITLDILTEIASLPTYLSSRAKLALDNIVMLHTTERGGRAYQHALNELPESLETLMLVALLGAMTAGIFLFFMQGKGIGKLSMGLITIAVASGLLWVAEIQPQWIAASIILEFFLMVLLIPEPEKQRTPQDNQLIYVILTILTIIGLIAANEMGLIEKTKTDFGFYQVKTETTILDVDLRPASAWTLYAVATTILTPMLRHTIENTSANLSLAAIANQAAVLMGLGKGWPLHRMDLGVPLLAMGCYSQVNPTTLTASLVMLLVHYAIIGPGLQAKATREAQKRTAAGIMKNPTVDGITVIDLEPISYDPKFEKQLGQVMLLVLCAGQLLLMRTTWAFCEVLTLATGPILTLWEGNPGRFWNTTIAVSTANIFRGSYLAGAGLAFSLIKNAQTPRRGTGTTGETLGEKWKRQLNSLDRKEFEEYKRSGILEVDRTEAKSALKDGSKIKHAVSRGSSKIRWIVERGMVKPKGKVVDLGCGRGGWSYYMATLKNVTEVKGYTKGGPGHEEPIPMATYGWNLVKLHSGVDVFYKPTEQVDTLLCDIGESSSNPTIEEGRTLRVLKMVEPWLSSKPEFCIKVLNPYMPTVIEELEKLQRKHGGNLVRCPLSRNSTHEMYWVSGASGNIVSSVNTTSKMLLNRFTTRHRKPTYEKDVDLGAGTRSVSTETEKPDMTIIGRRLQRLQEEHKETWHYDQENPYRTWAYHGSYEAPSTGSASSMVNGVVKLLTKPWDVIPMVTQLAMTDTTPFGQQRVFKEKVDTRTPQPKPGTRMVMTTTANWLWALLGKKKNPRLCTREEFISKVRSNAAIGAVFQEEQGWTSASEAVNDSRFWELVDKERALHQEGKCESCVYNMMGKREKKLGEFGRAKGSRAIWYMWLGARFLEFEALGFLNEDHWFGRENSWSGVEGEGLHRLGYILEEIDKKDGDLMYADDTAGWDTRITEDDLQNEELITEQMAPHHKILAKAIFKLTYQNKVVKVLRPTPRGAVMDIISRKDQRGSGQVGTYGLNTFTNMEVQLIRQMEAEGVITQDDMQNPKGLKERVEKWLRECGVDRLKRMAISGDDCVVKPLDERFGTSLLFLNDMGKVRKDIPQWEPSKGWKNWQEVPFCSHHFHKIFMKDGRSLVVPCRNQDELIGRARISQGAGWSLRETACLGKAYAQMWSLMYFHRRDLRLASMAICSAVPTEWFPTSRTTWSIHAHHQWMTTEDMLKVWNRVWIEDNPNMIDKTPVHSWEDIPYLGKREDLWCGSLIGLSSRATWAKNIHTAITQVRNLIGKEEYVDYMPVMKRYSAPSESEGVL

SEQ ID NO: 5192 - protein, 3288 aa, Artificial Sequence
  derived and/or modified protein sequence (wt) from DENV-4__FJ639737__SS-prME
STITLLCLIPTVMAFHLSTRDGEPLMIVAKHERGRPLLFKTTEGINKCTLIAMDLGEMCEDTVTYKCPLLINTEPEDIDCWCNLTSTWVMYGTCTQSGERRREKRSVALTPHSGMGLETRAETWMSSEGAWKHAQRVESWILRNPGFALLAGFMAYMIGQTGIQRTVFFVLMMLVAPSYGMRCVGVGNRDFVEGVSGGAWVDLVLEHGGCVTTMAQGKPTLDFELTKTTAKEVALLRTYCIEALISNITTATRCPTQGEPYLKEEQDQQYICRRDVVDRGWGNGCGLFGKGGVVTCAKFSCSGKITGNLVQIENLEYTVVVTVHNGDTHAVGNDTSNHGVTATITPRSPSVEVKLPDYGELTLDCEPRSGIDFNEMILMKMKKKTWLVHKQWFLDLPLPWTAGADTSEVHWNYKERMVTFKVPHAKRQDVTVLGSQEGAMHSALAGATEVDSGDGNHMFAGHLKCKVRMEKLRIKGMSYTMCSGKFSIDKEMAETQHGTTVVKVKYEGAGAPCKVPIEIRDVNKEKVVGRVISSTPLAENTNSVTNIELEPPFGDSYIVIGVGNSALTLHWFRKGSSIGKMFESTYRGAKRMAILGETAWDFGSVGGLFTSLGKAVHQVFGSVYTTMFGGVSWMIRILIGFLVLWIGTNSRNTSMAMTCIAVGGITLFLGFTVQADMGCVVSWSGRELKCGSGIFVVDNVHTWTEQYKFQPESPARLASAILNAHKDGVCGIRSTTRLENVMWKQITNELNYVLWEGGHDLTVVAGDVKGVLTKGKRALTPPVSDLKYSWKTWGKAKIFTPEARNSTFLIDGPDTSECPNERRAWNSLEVEDYGFGMFTTNIWMKFREGSSEVCDHRLMSAAIKDQKAVHADMGYWIESSKNQTWQIERASLIEVKTCLWPKTHTLWSNGVLESQMLIPKSYAGPFSQHNYRQGYATQTVGPWHLGKLEIDFGECPGTTVTIQEDCDHRGPSLRTTTASGKLVTQWCCRSCTMPPLRFLGEDGCWYGMEIRPLSEKEENMVKSQVTAGQGTSETFSMGLLCLTLFVEECLRRRVTRKHMILAVVITLCAIILGGLTWMDLLRALIMLGDTMSGRIGGQTHLAIMAVFKMSPGYVLGVFLRKLTSRETALMVIGMAMTTTLSIPHDLMELIDGISLGLILLKIVTQFDDTQVGTLALSLTFIRSTMSLVMAWRTIMAVLFVVTLIPLCRTSCLQKQSHWVEITALILGAQALPVYLMTLMKGASRRSWPLNEGIMAVGLVSLLGSALLKNDVPLAGPMVAGGLLLAAYVMSGSSADLSLEKAASVQWDEMADITGSSPIIEVKQDEDGSFSIRDVEETNMITLLVKLALITVSGLYPLAIPVTMTLWYMWQVKTQRSGALWDVPSPAATQKAALSEGVYRIMQRGLFGKTQVGVGIHIEGVFHTMWHVTRGSVICHETGRLEPSWADVRNDMISYGGGWRLGDKWDKEEDVQVLAIEPGKNPKHVQTKPGLFKTLTGEIGAVTLDFKPGTSGSPIINRKGKVIGLYGNGVVTKSGDYVSAITQAERIGEPDYEVDEDIFRKKRLTIMDLHPGAGKTKRILPSIVREALKRRLRTLILAPTRVVAAEMEEALRGLPIRYQTPAVKSEHTGREIVDLMCHATFTTRLLSSTRVPNYNLIVMDEAHFTDPSSVAARGYISTRVEMGEAAAIFMTATPPGATDPFPQSNSPIEDIEREIPERSWNTGFDWITDYQGKTVWFVPSIKAGNDIANCLRKSGKKVIQLSRKTFDTEYPKTKLTDWDFVVTTDISEMGANFRAGRVIDPRRCLKPVILTDGPERVILAGPIPVTPASAAQRRGRIGRNPAQEDDQYVFSGDPLKNDEDHAHWTEAKMLLDNIYTPEGIIPTLFGPEREKTQAIDGEFRLRGEQRKTFVELMRRGDLPVWLSYKVASAGISYKDREWCFTGERNNQILEENMEVEIWTREGEKKKLRPRWLDARVYADPMALKDFKEFASGRKSITLDILTEIASLPTYLSSRAKLALDNIVMLHTTERGGRAYQHALNELPESLETLMLVALLGAMTAGIFLFFMQGKGIGKLSMGLITIAVASGLLWVAEIQPQWIAASIILEFFLMVLLIPEPEKQRTPQDNQLIYVILTILTIIGLIAANEMGLIEKTKTDFGFYQVKTETTILDVDLRPASAWTLYAVATTILTPMLRHTIENTSANLSLAAIANQAAVLMGLGKGWPLHRMDLGVPLLAMGCYSQVNPTTLTASLVMLLVHYAIIGPGLQAKATREAQKRTAAGIMKNPTVDGITVIDLEPISYDPKFEKQLGQVMLLVLCAGQLLLMRTTWAFCEVLTLATGPILTLWEGNPGRFWNTTIAVSTANIFRGSYLAGAGLAFSLIKNAQTPRRGTGTTGETLGEKWKRQLNSLDRKEFEEYKRSGILEVDRTEAKSALKDGSKIKHAVSRGSSKIRWIVERGMVKPKGKVVDLGCGRGGWSYYMATLKNVTEVKGYTKGGPGHEEPIPMATYGWNLVKLHSGVDVFYKPIEQVDTLLCDIGESSSNPTIEEGRTLRVLKMVEPWLSSKPEFCIKVLNPYMPTVIEELEKLQRKHGGNLVRCPLSRNSTHEMYWVSGASGNIVSSVNTTSKMLLNRFTTRHRKPTYEKDVDLGAGTRSVSTETEKPDMTIIGRRLQRLQEEHKETWHYDQENPYRTWAYHGSYEAPSTGSASSMVNGVVKLLTKPWDVIPMVTQLAMTDTTPFGQQRVFKEKVDTRTPQPKPGTRMVMTTTANWLWALLGKKKNPRLCTREEFISKVRSNAAIGAVFQEEQGWTSASEAVNDSRFWELVDKERALHQEGKCESCVYNMMGKREKKLGEFGRAKGSRAIWYMWLGARFLEFEALGFLNEDHWFGRENSWSGVEGEGLHRLGYILEEIDKKDGDLMYADDTAGWDTRITEDDLQNEELITEQMAPHHKILAKAIFKLTYQNKVVKVLRPTPRGAVMDIISRKDQRGSGQVGTYGLNTFTNMEVQLIRQMEAEGVITQDDMQNPKGLKERVEKWLRECGVDRLKRMAISGDDCVVKPLDERFGTSLLFLNDMGKVRKDIPQWEPSKGWKNWQEVPFCSHHFHKIFMKDGRSLVVPCRNQDELIGRARISQGAGWSLRETACLGKAYAQMWSLMYFHRRDLRLASMAICSAVPTEWFPTSRTTWSIHAHHQWMTTEDMLKVWNRVWIEDNPNMIDKTPVHSWEDIPYLGKREDLWCGSLIGLSSRATWAKNIHTAITQVRNLIGKEEYVDYMPVMKRYSAPSESEGVL

SEQ ID NO: 5193 - protein, 3288 aa, Artificial Sequence
  derived and/or modified protein sequence (wt) from DENV-4__FJ639738__SS-prME
STITLLCLIPTVMAFHLSTRDGEPLMIVAKHERGRPLLFKTTEGINKCTLIAMDLGEMCEDTVTYKCPLLVNTEPEDIDCWCNLTSTWVMYGTCTQSGERRREKRSVALTPHSGMGLETRAETWMSSEGAWKHAQRVESWILRNPGFALLAGFMAYMIGQTGIQRTVFFVLMMLVAPSYGMRCVGVGNRDFVEGVSGGAWVDLVLEHGGCVTTMAQGKPTLDFELTKTTAKEVALLRTYCIEALISNITTATRCPTQGEPYLKEEQDQQYICRRDVVDRGWGNGCGLFGKGGVVTCAKFSCSGKITGNLVQIENLEYTVVVTVHNGDTHAVGNDTSNHGVTATITPRSPSVEVKLPDYGELTLDCEPRSGIDFNEMILMKMKKKTWLVHKQWFLDLPLPWTAGADTSEVHWNYKERMVTFKVPHAKRQDVTVLGSQEGAMHSALAGATEVDSGDGNHMFAGHLKCKVRMEKLRIKGMSYTMCSGKFSIDKEMAETQHGTTVVKVKYEGAGAPCKVPIEIRDVNKEKVVGRVISSTPLAENTNSVTNIELEPPFGDSYIVIGVGNSALTLHWFRKGSSIGKMFESTYRGAKRMAILGETAWDFGSVGGLFTSLGKAVHQVFGSVYTTMFGGVSWMIRILIGFLVLWIGTNSRNTSMAMTCIAVGGITLFLGFTVQADMGCVVSWSGRELKCGSGIFVVDNVHTWTEQYKFQPESPARLASAILNAHKDGVCGIRSTTRLENVMWKQITNELNYVLWEGGHDLTVVAGDVKGVLTKGKRALTPPVSDLKYSWKTWGKAKIFTPEARNSTFLIDGPDTSECPNERRAWNSLEVEDYGFGMFTTNIWMKFREGSSEVCDHRLMSAAIKDQKAVHADMGYWIESSKNQTWQIERASLIEVKTCLWPKTHTLWSNGVLESQMLIPKSYAGPFSQHNYRQGYATQTVGPWHLGKLEIDFGECPGTTVTIQEDCDHRGPSLRTTTASGKLVTQWCCRSCTMPPLRFLGEDGCWYGMEIRPLSEKEENMVKSQVTAGQGTSETFSMGLLCLTLFVEECLRRRVTRKHMILAVVITLCAIILGGLTWMDLLRALIMLGDTMSGRIGGQTHLAIMAVFKMSPGYVLGVFLRRLTSRETALMVIGMAMTTTLSIPHDLMELIDGISLGLILLKIVTQFDNTQVGTLALSLTFIRSTMSLVMAWRTIMAVLFVVTLIPLCRTSCLQKQSHWVEITALILGAQALPVYLMTLMKGASRRSWPLNEGIMAVGLVSLLGSALLKNDVPLAGPMVAGGLLLAAYVMSGSSADLSLEKAANVQWDEMADITGSSPIIEVKQDEDGSFSIRDVEETNMITLLVKLALITVSGLYPLAIPVTMTLWYMWQVKTQRSGALWDVPSPAATQKAALSEGVYRIMQRGLFGKTQVGVGIHMEGVFHTMWHVTRGSVICHETGRLEPSWADVRNDMISYGGGWRLGDKWDKEEDVQVLAVEPGKNPKHVQTKPGLFKTITGEIGAVTLDFKPGTSGSPIINRKGKVIGLYGNGVVTKSGDYVSAITQAERIGEPDYEVDEDIFRKKRLTIMDLHPGAGKTKRILPSIVREALKRRLRTLILAPTRVVAAEMEEALRGLPIRYQTPAVKSEHTGREIVDLMCHATFTTRLLSSTRVPNYNLIVMDEAHFTDPSSVAARGYISTRVEMGEAAAIFMTATPPGATDPFPQSNSPIEDIEREIPERSWNTGFDWITDYQGKTVWFVPSIKAGNDIANCLRKSGKKVIQLSRKTFDTEYPKTKLTDWDFVVTTDISEMGANFRAGRVIDPRRCLKPVILTDGPERVILAGPIPVTPASAAQRRGRIGRNPAQEDDQYVFSGDPLKNDEDHAHWTEAKMLLDNIYTPEGIIPTLFGPEREKTQAIDGEFRLRGEQRKTFVELMRRGDLPVWLSYKVASAGISYKDREWCFTGERNNQILEENMEVEIWTREGEKKKLRPRWLDARVYADPMALKDFKEFASGRKSITLDILTEIASLPTYLSSRAKLALDNIVMLHTTERGGRAYQHALNELPESLETLMLVALLGAMTAGIFLFFMQGKGIGKLSMGLITIAVASGLLWVAEIQPQWIAASIILEFFLMVLLIPEPEKQRTPQDNQLIYVILTILTIIGLIAANEMGLIEKTKTDFGFYQVKTETTILDVDLRPASAWTLYAVATTILTPMLRHTIENTSANLSLAAIANQAAVLMGLGKGWPLHRMDLGVPLLAMGCYSQVNPTTLTASLVMLLVHYAIIGPGLQAKATREAQKRTAAGIMKNPTVDGITVIDLEPISYDPKFEKQLGQVMLLVLCAGQLLLMRTTWAFCEVLTLATGPILTLWEGNPGRFWNTTIAVSTANIFRGSYLAGAGLAFSLIKNAQTPRRGTGTTGETLGEKWKRQLNSLDRKEFEEYKRSGILEVDRTEAKSALKDGSKIKHAVSRGSSKIRWIVERGMVKPKGKVVDLGCGRGGWSYYMATLKNVTEVKGYTKGGPGHEEPIPMATYGWNLVKLHSGVDVFYKPTEQVDTLLCDIGESSSNPTIEEGRTLRVLKMVEPWLSSKPEFCIKVLNPYMPTVIEELEKLQRKHGGNLVRCPLSRNSTHEMYWVSGASGNIVSSVNTTSKMLLNRFTTRHRKPTYEKDVDLGAGTRSVSTETEKPDMTIIGRRLQRLQEEHKETWHYDQENPYRTWAYHGSYEAPSTGSASSMVNGVVKLLTKPWDVIPMVTQLAMTDTTPFGQQRVFKEKVDTRTPQPKPGTRMVMTTTANWLWALLGKKKNPRLCTREEFISKVRSNAAIGAVFQEEQGWTSASEAVNDSRFWELVDKERALHQEGKCESCVYNMMGKREKKLGEFGRAKGSRAIWYMWLGARFLEFEALGFLNEDHWFGRENSWSGVEGEGLHRLGYILEEIDKKDGDLMYADDTAGWDTRITEDDLQNEELITEQMAPHHKILAKAIFKLTYQNKVVKVLRPTPRGAVMDIISRKDQRGSGQVGTYGLNTFTNMEVQLIRQMEAEGVITQDDMQNPKGLKERVEKWLRECGVDRLKRMAISGDDCVVKPLDERFGTSLLFLNDMGKVRKDIPQWEPSKGWKNWQEVPFCSHHFHKIFMKDGRSLVVPCRNQDELIGRARISQGAGWSLRETACLGKAYAQMWSLMYFHRRDLRLASMAICSAVPTEWFPTSRTTWSIHAHHQWMTTEDMLKVWNRVWIEDNPNMIDKTPVHSWEDIPYLGKREDLWCGSLIGLSSRATWAKNIHTAITQVRNLIGKEEYVDYMPVMKRYSAPSESEGVL

SEQ ID NO: 5194 - protein, 3288 aa, Artificial Sequence
  derived and/or modified protein sequence (wt) from DENV-4__FJ639739__SS-prME
STMTLLCLIPTAMAFHLSTRDGEPLMIVAKHERGRPLLFKTTEGINKCTLIAMDLGEMCEDTVTYKCPLLVNTEPEDIDCWCNLTSTWVMYGTCTQSGERRREKRSVALTPHSGMGLETRAETWMSSEGAWKHAQRVESWILRNPGFALLAGFMAYMIGQTGIQRTVFFVLMMLVAPSYGMRCVGVGNRDFVEGVSGGAWVDLVLEHGGCVTTMAQGKPTLDFELTKTTAKEVALLRTYCIEALISNITTATRCPTQGEPYLKEEQDQQYICRRDVVDRGWGNGCGLFGKGGVVTCAKFSCSGKITGNLVQIENLEYTVVVTVHNGDTHAVGNDTSNHGVTATITPRSPSVEVKLPDYGELTLDCEPRSGIDFNEMILMKMKKKTWLVHKQWFLDLPLPWTAGADTSEVHWNYKERMVTFKVPHAKRQDVTVLGSQEGAMHSALAGATEVDSGDGNHMFAGHLKCKVRMEKLRIKGMSYTMCSGKFSIDKEMAETQHGTTVVKVKYEGAGAPCKVPIEIRDVNKEKVVGRVISSTPLAENTNSVTNIELEPPFGDSYIVIGVGNSALTLHWFRKGSSIGKMFESTYRGAKRMAILGETAWDFGSVGGLFTSLGKAVHQVFGSVYTTMFGGVSWMIRILIGFLVLWIGTNSRNTSMAMTCIAVGGITLFLGFTVQADMGCVVSWSGRELKCGSGIFVVDNVHTWTEQYKFQPESPARLASAILNAHKDGVCGIRSTTRLENVMWKQITNELNYVLWEGGHDLTVVAGDVKGVLTKGKRALTPPVSDLKYSWKTWGKAKIFTPEARNSTFLIDGPDTSECPNERRAWNSLEVEDYGFGMFTTNIWMKFREGSSEVCDHRLMSAAIKDQKAVHADMGYWIESSKNQTWQIERASLIEVKTCLWPKTHTLWSNGVLESQMLIPKSYAGPFSQHNYRQGYATQTVGPWHLGKLEIDFGECPGTTVTIQEDCDHRGPSLRTTTASGKLVTQWCCRSCTMPPLRFLGEDGCWYGMEIRPLSEKEENMVKSQVTAGQGTSETFSMGLLCLTLFVEECLRRRVTRKHMILAVVITLCAIILGGLTWMDLLRALIMLGDTMSGRIGGQTHLAIMAVFKMSPGYVLGVFLRKLTSRETALMVIGMAMTTTLSIPHDLMELIDGISLGLILLKIVTQFDNTQVGTLALSLTFIRSTMSLVMAWRTIMAVLFVVTLIPLCRTSCLQKQSHWVEITALILGAQALPVYLMTLMKGASRRSWPLNEGIMAVGLVSLLGSALLKNDVPLAGPMVAGGLLLAAYVMSGSSADLSLEKAANVQWDEMADITGSSPIIEVKQDEDGSFSIRDVEETNMITLLVKLALITVSGLYPLAIPVTMTLWYMWQVKTQRSGALWDVPSPAATQKAALSEGVYRIMQRGLFGKTQVGVGIHMEGVFHTMWHVTRGSVICHETGRLEPSWADVRNDMISYGGGWRLGDKWDKEEDVQVLAIEPGKNPKHVQTKPGLFKTLAGEIGAVTLDFKPGTSGSPIINRKGKVIGLYGNGVVTKSGDYVSAITQAERIGEPDYEVDEDIFRKKRLTIMDLHPGAGKTKRILPSIVREALKRRLRTLILAPTRVVAAEMEEALRGLPIRYQTPAVKSEHTGREIVDLMCHATFTTRLLSSTRVPNYNLIVMDEAHFTDPSSVAARGYISTRVEMGEAAAIFMTATPPGATDPFPQSNSPIEDIEREIPERSWNTGFDWITDYQGKTVWFVPSIKAGNDIANCLRKSGKKVIQLSRKTFDTEYPKTKLTDWDFVVTTDISEMGANFRAGRVIDPRRCLKPVILTDGPERVILAGPIPVTPASAAQRRGRIGRNPAQEDDQYVFSGDPLKNDEDHAHWTEAKMLLDNIYTPEGIIPTLFGPEREKTQAIDGEFRLRGEQRKTFVELMRRGDLPVWLSYKVASAGISYKDREWCFTGERNNQILEENMEVEIWTREGEKKKLRPRWLDARVYADPMALKDFKEFASGRKSITLDILTEIASLPTYLSSRAKLALDNIVMLHTTERGGRAYQHALNELPESLETLMLVALLGAMTAGIFLFFMQGKGIGKLSMGLITIAVASGLLWVAEIQPQWIAASIILEFFLMVLLIPEPEKQRTPQDNQLIYVILTILTIIGLIAANEMGLIEKTKTDFGFYQVKTETTILDVDLRPASAWTLYAVATTILTPMLRHTIENTSANLSLAAIANQAAVLMGLGKGWPLHRMDLGVPLLAMGCYSQVNPTTLTASLVMLLVHYAIIGPGLQAKATREAQKRTAAGIMKNPTVDGITVIDLEPISYDPKFEKQLGQVMLLVLCAGQLLLMRTTWAFCEVLTLATGPILTLWEGNPGRFWNTTIAVSTANIFRGSYLAGAGLAFSLIKNAQTPRRGTGTTGETLGEKWKRQLNSLDRKEFEEYKRSGILEVDRTEAKSALKDGSKIKHAVSRGSSKIRWIVERGMVKPKGKIVDLGCGRGGWSYYMATLKNVTEVKGYTKGGPGHEEPIPMATYGWNLVKLHSGVDVFYKPTEQVDTLLCDIGESSSNPTIEEGRTLRVLKMVEPWLSSKPEFCIKVLNPYMPTVIEELEKLQRKHGGNLVRCPLSRNSTHEMYWVSGASGNIVSSVNTTSKMLLNRFTTRHRKPTYEKDVDLGAGTRSVSTETEKPDMTIIGRRLQRLQEEHKETWHYDQENPYRTWAYHGSYEAPSTGSASSMVNGVVKLLTKPWDVIPMVTQLAMTDTTPFGQQRVFKEKVDTRTPQPKPGTRMVMTTTANWLWALLGKKKNPRLCTREEFISKVRSNAAIGAVFQEEQGWTSASEAVNDSRFWELVDKERALHQEGKCESCVYNMMGKREKKLGEFGRAKGSRAIWYMWLGARFLEFEALGFLNEDHWFGRENSWSGVEGEGLHRLGYILEEIDKKDGDLMYADDTAGWDTRITEDDLQNEELITEQMAPHHKILAKAIFKLTYQNKVVKVLRPTPRGAVMDIISRKDQRGSGQVGTYGLNTFTNMEVQLIRQMEAEGVITQDDMQNPKGLKERVEKWLRECGVDRLKRMAISGDDCVVKPLDERFGTSLLFLNDMGKVRKDIPQWEPSKGWKNWQEVPFCSHHFHKIFMKDGRSLVVPCRNQDELIGRARISQGAGWSLRETACLGKAYAQMWSLMYFHRRDLRLASMAICSAVPTEWLPTSRTTWSIHAHHQWMTTEDMLKVWNRVWIEDNPNMIDKTPVHSWEDIPYLGKREDLWCGSLIGLSSRATWAKNIHTAITQVRNLIGKEEYVDYMPVMKRYSAPSESEGVL

SEQ ID NO: 5195 - protein, 3288 aa, Artificial Sequence
  derived and/or modified protein sequence (wt) from DENV-4__JN819409__SS-prME
STITLLCLIPTVMAFHLSTRDGEPLMIVAKHERGRPLLFKTTEGINKCTLIAMDLGEMCEDTVTYKCPLLVNTEPEDIDCWCNLTATWVMYGTCTQSGERRREKRSVALTPHSGMGLETRAETWMSSEGAWKHAQRVESWILRNPGFALLAGFMAYMIGQTGIQRTVFFVLMMLVAPSYGMRCVGVGNRDFVEGVSGGAWVDLVLEHGGCVTTMAQGKPTLDFELTKTTAKEVALLRTYCIEALISNITTATRCPTQGEPYLKEEQDQQYICRRDVVDRGWGNGCGLFGKGGVVTCAKFSCSGKITGNLVQIENLEYTVVVTVHNGDTHAVGNDTSNHGVTATITPRSPSVEVKLPDYGELTLDCEPRSGIDFNEMILMKMKKKTWLVHKQWFLDLPLPWTAGADTSEVHWNYKERMVTFKVPHAKRQDVTVLGSQEGAMHSALAGATEVDSGDGNHMFAGHLKCKVRMEKLRIKGMSYTMCSGKFSIDKEMAETQHGTTVVKVKYEGAGAPCKVPIEIRDVNKEKVVGRVISSTPLAENTNGVTNIELEPPFGDSYIVIGVGNSALTLHWFRKGSSIGKMFESTYRGAKRMAILGETAWDFGSVGGLFTSLGKAVHQVFGSVYTTMFGGVSWMIRILIGFLVLWIGTNSRNTSMAMTCIAVGGITLFLGFTVQADMGCVVSWSGRELKCGSGIFVVDNVHTWTEQYKFQPESPARLASAILNAHKDGVCGIRSTTRLENVMWKQITNELNYVLWEGGHDLTVVAGDVKGVLTKGKRALTPPVSDLKYSWKTWGKAKIFTPEARNSTFLIDGPDTSECPNERRAWNSLEVEDYGFGMFTTNIWMKFREGSSEVCDHRLMSAAIKDQKAVHADMGYWIESSKNQTWQIERASLIEVKTCLWPKTHTLWSNGVLESQMLIPKSYAGPFSQHNYRQGYATQTVGPWHLGKLEIDFGECPGTTVTIQEDCDHRGPSLRTTTASGKLVTQWCCRSCTMPPLRFLGEDGCWYGMEIRPLSEKEENMVKSQVTAGQGTSETFSMGLLCLTLFVEECLRRRVTRKHMILAVIITLCAIILGGLTWMDLLRALIMLGDTMSGRIGGQTHLAIMAVFKMSPGYVLGVFLRKLTSRETALMVIGMAMTTTLSIPHDLMELIDGISLGLILLKIVTQFDNTQVGTLALSLTFIRSTMSLVMAWRTIMAVLFVVTLIPLCRTSCLQKQSHWVEITALILGAQALPVYLMTLMKGASRRSWPLNEGIMAVGLVSLLGSALLKNDVPLAGPMVAGGLLLAAYVMSGSSADLSLEKAANVQWDEMADITGSSPIIEVKQDEDGSFSIRDVEETNMITLLVKLALITVSGLYPLAIPVTMTLWYMWQVKTQRSGALWDVPSPAATQKAALSEGVYRIMQRGLFGKTQVGVGIHMEGVFHTMWHVTRGSVICHETGRLEPSWADVRNDMISYGGGWRLGDKWDKEEDVQVLAIEPGKNPKHVQTKPGLFKTLTGEIGAVTLDFKPGTSGSPIINRKGKVIGLYGNGVVTKSGDYVSAITQAERIGEPDYEVDEDIFRKKRLTIMDLHPGAGKTKRILPSIVREALKRRLRTLILAPTRVVAAEMEEALRGLPIRYQTPAVKSEHTGREIVDLMCHATFTTRLLSSTRVPNYNLIVMDEAHFTDPSSVAARGYISTRVEMGEAAAIFMTATPPGATDPFPQSNSPIEDIEREIPERSWNTGFDWITDYQGKTVWFVPSIKAGNDIANCLRKSGKKVIQLSRKTFDTEYPKTKLTDWDFVVTTDISEMGANFRAGRVIDPRRCLKPVILTDGPERVILAGPIPVTPASAAQRRGRIGRNPAQEDDQYVFSGDPLKNDEDHAHWTEAKMLLDNIYTPEGIIPTLFGPEREKTQAIDGEFRLRGEQRKTFVELMRRGDLPVWLSYKVASAGISYKDREWCFTGERNNQILEENMEVEIWTREGEKKKLRPRWLDARVYADPMALKDFKEFASGRKSITLDILTEIASLPTYLSSRAKLALDNIVMLHTTERGGRAYQHALNELPESLETLMLVALLGAMTAGIFLFFMQGKGIGKLSMGLITIAVASGLLWVAEIQPQWIAASIILEFFLMVLLIPEPEKQRTPQDNQLIYVILTILTIIGLIAANEMGLIEKTKTDFGFYQVKTETTILDVDLRPASAWTLYAVATTILTPMLRHTIENTSANLSLAAIANQAAVLMGLGKGWPLHRMDLGVPLLAMGCYSQVNPTTLTASLVMLLVHYAIIGPGLQAKATREAQKRTAAGIMKNPTVDGITVIDLEPISYDPKFEKQLGQVMLLVLCAGQLLLMRTTWAFCEVLTLATGPILTLWEGNPGRFWNTTIAVSTANIFRGSYLAGAGLAFSLIKNAQTPRRGTGTTGETLGEKWKRQLNSLDRKEFEEYKRSGILEVDRTEAKSALKDGSKIKHAVSRGSSKIRWIVERGMVKPKGKVVDLGCGRGGWSYYMATLKNVTEVKGYTKGGPGHEEPIPMATYGWNLVKLHSGVDVFYKPTEQVDTLLCDIGESSSNPTIEEGRTLRVLKMVEPWLSSKPEFCIKVLNPYMPTVIEELEKLQRKHGGNLVRCPLSRNSTHEMYWVSGASGNIVSSVNTTSKMLLNRFTTRHRKPTYEKDVDLGAGTRSVSTETEKPDMTIIGRRLQRLQEEHKETWHYDQENPYRTWAYHGSYEAPSTGSASSMVNGVVKLLTKPWDVIPMVTQLAMTDTTPFGQQRVFKEKVDTRTPQPKPGTRMVMTTTANWLWALLGKKKNPRLCTKEEFISKVRSNAAIGAVFQEEQGWTSASEAVNDSRFWELVDKERALHQEGKCESCVYNMMGKREKKLGEFGRAKGSRAIWYMWLGARFLEFEALGFLNEDHWFGRENSWSGVEGEGLHRLGYILEEIDKKDGDLMYADDTAGWDTRITEDDLQNEELITEQMAPHHKILAKAIFKLTYQNKVVKVLRPTPRGAVMDIISRKDQRGSGQVGTYGLNTFTNMEVQLIRQMEAEGVITQDDMQNPKGLKERVEKWLRECGVDRLKRMAISGDDCVVKPLDERFGTSLLFLNDMGKVRKDIPQWEPSKGWKNWQEVPFCSHHFHKIFMKDGRSLVVPCRNQDELIGRARISQGAGWSLRETACLGKAYAQMWSLMYFHRRDLRLASMAICSAVPTEWFPTSRTTWSIHAHHQWMTTEDMLKVWNRVWIEDNPNMTDKTPIHSWEDIPYLGKREDLWCGSLIGLSSRATWAKNIHTAITQVRNLIGKEEYVDYMPVMKRYSAPSESEGVL

SEQ ID NO: 5196 - protein, 3288 aa, Artificial Sequence
  derived and/or modified protein sequence (wt) from DENV-4__FJ639742__SS-prME
STMTLLCLIPTAMAFHLSTRDGEPLMIVAKHERGRPLLFKTTEGINKCTLIAMDLGEMCEDTVTYKCPLLVNTEPEDIDCWCNLTSTWVMYGTCTQSGERRREKRSVALTPHSGMGLETRAETWMSSEGAWKHAQRVESWILRNPGFALLAGFMAYMVGQTGIQRTVFFVLMMLVAPSYGMRCVGVGNRDFVEGVSGGAWVDLVLEHGGCVTTMAQGKPTLDFELTKTTAKEVALLRTYCIEALISNITTATRCPTQGEPYLKEEQDQQYICRRDVVDRGWGNGCGLFGKGGVVTCAKFSCSGKITGNLVQIENLEYTVVVTVHNGDTHAVGNDTSNHGVTATITPRSPSVEVKLPDYGELTLDCEPRSGIDFNEMILMKMKKKTWLVHKQWFLDLPLPWTAGADTSEVHWNYKERMVTFKVPHAKRQDVTVLGSQEGAMHSALAGATEVDSGDGNHMFAGHLKCKVRMEKLRIKGMSYTMCSGKFSIDKEMAETQHGTTVVKVKYEGAGAPCKVPIEIRDVNKEKVVGRVISSTPLAENTNSVTNIELEPPFGDSYIVIGVGNSALTLHWFRKGSSIGKMFESTYRGAKRMAILGETAWDFGSVGGLFTSLGKAVHQVFGSVYTTMFGGVSWMIRILIGFLVLWIGTNSRNTSMAMTCIAVGGITLFLGFTVQADMGCVVSWSGRELKCGSGIFVVDNVHTWTEQYKFQPESPARLASAILNAHKDGVCGIRSTTRLENVMWKQITNELNYVLWEGGHDLTVVAGDVKGVLTKGKRALTPPVSDLKYSWKTWGKAKIFTPEARNSTFLIDGPDTSECPNERRAWNSLEVEDYGFGMFTTNIWMKFREGSSEVCDHRLMSAAIKDQKAVHADMGYWIESSKNQTWQIERASLIEVKTCLWPKTHTLWSNGVLESQMLIPKSYAGPFSQHNYRQGYATQTVGPWHLGKLEIDFGECPGTTVTIQEDCDHRGPSLRTTTASGKLVTQWCCRSCTMPPLRFLGEDGCWYGMEIRPLSEKEENMVKSQVTAGQGTSETFSMGLLCLTLFVEECLRRRVTRKHMILAVVITLCAIILGGLTWMDLLRALIMLGDTMSGRIGGQTHLAIMAVFKMSPGYVLGVFLRKLTSRETALMVIGMAMTTTLSIPHDLMELIDGISLGLILLKIVTQFDNTQVGTLALSLTFIRSTMSLVMAWRTIMAVLFVVTLIPLCRTSCLQKQSHWVEITALILGAQALPVYLMTLMKGASRRSWPLNEGIMAVGLVSLLGSALLKNDVPLAGPMVAGGLLLAAYVMSGSSADLSLEKAASVQWDEMADITGSSPIIEVKQDEDGSFSIRDVEETNMITLLVKLALITVSGLYPLAIPVTMTLWYMWQVKTQRSGALWDVPSPAATQKAALSEGVYRIMQRGLFGKTQVGVGIHMEGVFHTMWHVTRGSVICHETGRLEPSWADVRNDMISYGGGWRLGDKWDKEEDVQVLAIEPGKNPKHVQTKPGLFKTLTGEIGAVTLDFKPGTSGSPIINRKGKVIGLYGNGVVTKSGDYVSAITQAERIGEPDYEVDEDIFRKKRLTIMDLHPGAGKTKRILPSIVREALKRRLRTLILAPTRVVAAEMEEALRGLPIRYQTPAVKSEHTGREIVDLMCHATFTTRLLSSTRVPNYNLIVMDEAHFTDPSSVAARGYISTRVEMGEAAAIFMTATPPGATDPFPQSNSPIEDIEREIPERSWNTGFDWITDYQGKTVWFVPSIKAGNDIANCLRKSGKKVIQLSRKTFDTEYPKTKLTDWDFVVTTDISEMGANFRAGRVIDPRRCLKPVILTDGPERVILAGPIPVTPASAAQRRGRIGRNPAQEDDQYVFSGDPLKNDEDHAHWTEAKMLLDNIYTPEGIIPTLFGPEREKTQAIDGEFRLRGEQRKTFVELMRRGDLPVWLSYKVASAGISYKDREWCFTGERNNQILEENMEVEIWTREGEKKKLRPRWLDARVYADPMALKDFKEFASGRKSITLDILTEIASLPTYLSSRAKLALDNIVMLHTTERGGRAYQHALNELPESLETLMLVALLGAMTAGIFLFFMQGKGIGKLSMGLITIAVASGLLWVAEIQPQWIAASIILEFFLMVLLIPEPEKQRTPQDNQLIYVILTILTIIGLIAANEMGLIEKTKTDFGFYQVKTETTILDVDLRPASAWTLYAVATTILTPMLRHTIENTSANLSLAAIANQAAVLMGLGKGWPLHRMDLGVPLLAMGCYSQVNPTTLTASLVMLLVHYAIIGPGLQAKATREAQKRTAAGIMKNPTVDGITVIDLEPISYDPKFEKQLGQVMLLVLCAGQLLLMRTTWAFCEVLTLATGPILTLWEGNPGRFWNTTIAVSTANIFRGSYLAGAGLAFSLIKNAQTPRRGTGTTGETLGEKWKRQLNSLDRKEFEEYKRSGILEVDRTEAKSALKDGSKIKHAVSRGSSKIRWIVERGMVKPKGKVVDLGCGRGGWSYYMATLKNVTEVKGYTKGGPGHEEPIPMATYGWNLVKLHSGVDVFYKPTEQVDTLLCDIGESSSNPTIEEGRTLRVLKMVEPWLSSKPEFCIKVLNPYMPTVIEELEKLQRKHGGNLVRCPLSRNSTHEMYWVSGASGNIVSSVNTTSKMLLNRFTTRHRKPTYEKDVDLGAGTRSVSTETEKPDMTIIGRRLQRLQEEHKETWHYDQENPYRTWAYHGSYEAPSTGSASSMVNGVVKLLTKPWDVIPMVTQLAMTDTTPFGQQRVFKEKVDTRTPQPKPGTRMVMTTTANWLWALLGKKKNPRLCTREEFISKVRSNAAIGAVFQEEQGWTSASEAVNDSRFWELVDKERALHQEGKCESCVYNMMGKREKKLGEFGRAKGSRAIWYMWLGARFLEFEALGFLNEDHWFGRENSWSGVEGEGLHRLGYILEEIDKKDGDLMYADDTAGWDTRITEDDLQNEELITEQMAPHHKILAKAIFKLTYQNKVVKVLRPTPRGAVMDIISRKDQRGSGQVGTYGLNTFTNMEVQLIRQMEAEGVITQDDMQNPKGLKERVEKWLRECGVDRLKRMAISGDDCVVKPLDERFGTSLLFLNDMGKVRKDIPQWEPSKGWKNWQEVPFCSHHFHKIFMKDGRSLVVPCRNQDELIGRARISQGAGWSLRETACLGKAYAQMWSLMYFHRRDLRLASMAICSAVPTEWFPTSRTTWSIHAHHQWMTTEDMLKVWNRVWIEDNPNMIDKTPVHSWEDIPYLGKREDLWCGSLIGLSSRATWAKNIHTAITQVRNLIGKEEYVDYMPVMKRYSAPSESEGVL

SEQ ID NO: 5197 - protein, 3288 aa, Artificial Sequence
  derived and/or modified protein sequence (wt) from DENV-4__FJ639745__SS-prME
STMTLLCLIPTAMAFHLSTRDGEPLMIVAKHERGRPLLFKTTEGINKCTLIAMDLGEMCEDTVTYKCPLLVNTEPEDIDCWCNLTSTWVMYGTCTQSGERRREKRSVALTPHSGMGLETRAETWMSSEGAWKHAQRVESWILRNPGFALLAGFMAYMIGQTGIQRTVFFVLMMLVAPSYGMRCVGVGNRDFVEGVSGGAWVDLVLEHGGCVTTMAQGKPTLDFELTKTTAKEVALLRTYCIEALISNITTATRCPTQGEPYLKEEQDQQYICRRDVVDRGWGNGCGLFGKGGVVTCAKFSCSGKITGNLVQIENLEYTVVVTVHNGDTHAVGNDTSNHGVTATITPRSPSVEVKLPDYGELTLDCEPRSGIDFNEMILMKMKKKTWLVHKQWFLDLPLPWTAGADTSEVHWNYKERMVTFKVPHAKRQDVTVLGSQEGAMHSALAGATEVDSGDGNHMFAGHLKCKVRMEKLRIKGMSYTMCSGKFSIDKEMAETQHGTTVVKVKYEGAGAPCKVPIEIRDVNKEKVVGRVISSTPLAENTNSVTNIELEPPFGDSYIVIGVGNSALTLHWFRKGSSIGKMFESTYRGAKRMAILGETAWDFGSVGGLFTSLGKAVHQVFGSVYTTMFGGVSWMIRILIGLLVLWIGTNSRNTSMAMTCIAVGGITLFLGFTVQADMGCVVSWSGRELKCGSGIFVVDNVHTWTEQYKFQPESPARLASAILNAHKDGVCGIRSTTRLENVMWKQITNELNYVLWEGGHDLTVVAGDVKGVLTKGKRALTPPVSDLKYSWKTWGKAKIFTPEARNSTFLIDGPDTSECPNERRAWNSLEVEDYGFGMFTTNIWMKFREGSSEVCDHRLMSAAIKDQKAVHADMGYWIESSKNQTWQIERASLIEVKTCLWPKTHTLWSNGVLESQMLIPKSYAGPFSQHNYRQGYATQTVGPWHLGKLEIDFGECPGTTVTIQEDCDHRGPSLRTTTASGKLVTQWCCRSCTMPPLRFLGEDGCWYGMEIRPLSEKEENMVKSQVTAGQGTSETFSMGLLCLTLFVEECLRRRVTRKHMILAVVITLCAIILGGLTWMDLLRALIMLGDTMSGRIGGQTHLAIMAVFKMSPGYVLGVFLRKLTSRETALMVIGMAMTTTLSIPHDLMELIDGISLGLILLKIVTQFDNTQVGTLALSLTFIRSTMSLVMAWRTIMAVLFVVTLIPLCRTSCLQKQSHWVEITALILGAQALPVYLMTLMKGASRRSWPLNEGIMAVGLVSLLGSALLKNDVPLAGPMVAGGLLLAAYVMSGSSADLSLEKAANVQWDEMADITGSSPIIEVKQDEDGSFSIRDVEETNMITLLVKLALITVSGLYPLAIPVTMTLWYMWQVKTQRSGALWDVPSPAATQKAALSEGVYRIMQRGLFGKTQVGVGIHMEGVFHTMWHVTRGSVICHETGRLEPSWADVRNDMISYGGGWRLGDKWDKEEDVQVLAIEPGKNPKHVQTKPGLFKTLTGEIGAVTLDFKPGTSGSPIINRKGKVIGLYGNGVVTKSGDYVSAITQAERIGEPDYEVDEDIFRKKRLTIMDLHPGAGKTKRILPSIVREALKRRLRTLILAPTRVVAAEMEEALRGLPIRYQTPAVKSEHTGREIVDLMCHATFTTRLLSSTRVPNYNLIVMDEAHFTDPSSVAARGYISTRVEMGEAAAIFMTATPPGATDPFPQSNSPIEDIEREIPERSWNTGFDWITDYQGKTVWFVPSIKAGNDIANCLRKSGKKVIQLSRKTFDTEYPKTKLTDWDFVVTTDISEMGANFRAGRVIDPRRCLKPVILTDGPERVILAGPIPVTPASAAQRRGRIGRNPAQEDDQYVFSGDPLKNDEDHAHWTEAKMLLDNIYTPEGIIPTLFGPEREKTQAIDGEFRLRGEQRKTFVELMRRGDLPVWLSYKVASAGISYKDREWCFTGERNNQILEENMEVEIWTREGEKKKLRPRWLDARVYADPMALKDFKEFASGRKSITLDILTEIASLPTYLSSRAKLALDNIVMLHTTERGGRAYQHALNELPESLETLMLVALLGAMTAGIFLFFMQGKGIGKLSMGLITIAVASGLLWVAEIQPQWIAASIILEFFLMVLLIPEPEKQRTPQDNQLIYVILTILTIIGLIAANEMGLIEKTKTDFGFYQVKTETTILDVDLRPASAWTLYAVATTILTPMLRHTIENTSANLSLAAIANQAAVLMGLGKGWPLHRMDLGVPLLAMGCYSQVNPTTLTASLVMLLVHYAIIGPGLQAKATREAQKRTAAGIMKNPTVDGITVIDLEPISYDPKFEKQLGQVMLLVLCAGQLLLMRTTWAFCEVLTLATGPILTLWEGNPGRFWNTTIAVSTANIFRGSYLAGAGLAFSLIKNAQTPRRGTGTTGETLGEKWKRQLNSLDRKEFEEYKRSGILEVDRTEAKSALKDGSKIKHAVSRGSSKIRWIVERGMVKPKGKVVDLGCGRGGWSYYMATLKNVTEVKGYTKGGPGHEEPIPMATYGWNLVKLHSGVDVFYKPTEQVDTLLCDIGESSSNPTIEEGRTLRVLKMVEPWLSSKPEFCIKVLNPYMPTVIEELEKLQRKHGGNLVRCPLSRNSTHEMYWVSGASGNIVSSVNTTSKMLLNRFTTRHRKPTYEKDVDLGAGTRSVSTETEKPDMTIIGRRLQRLQEEHKETWHYDQENPYRTWAYHGSYEAPSTGSASSMVNGVVKLLTKPWDVIPMVTQLAMTDTTPFGQQRVFKEKVDTRTPQPKPGTRMVMTTTANWLWALLGKKKNPRLCTREEFISKVRSNAAIGAVFQEEQGWTSASEAVNDSRFWELVDKERALHQEGKCESCVYNMMGKREKKLGEFGRAKGSRAIWYMWLGARFLEFEALGFLNEDHWFGRENSWSGVEGEGLHRLGYILEEIDKKDGDLMYADDTAGWDTRITEDDLQNEELITEQMAPHHKILAKAIFKLTYQNKVVKVLRPTPRGAVMDIISRKDQRGSGQVGTYGLNTFTNMEVQLIRQMEAEGVITQDDMQNPKGLKERVEKWLRECGVDRLKRMAISGDDCVVKPLDERFATSLLFLNDMGKVRKDIPQWEPSKGWKNWQEVPFCSHHFHKIFMKDGRSLVVPCRNQDELIGRARISQGAGWSLRETACLGKAYAQMWSLMYFHRRDLRLASMAICSAVPTEWFPTSRTTWSIHAHHQWMTTEDMLKVWNRVWIEDNPNMIDKTPVHSWEDIPYLGKREDLWCGSLIGLSSRATWAKNIHTAITQVRNLIGKEEYVDYMPVMKRYSAPSESEGVL

SEQ ID NO: 5198 - protein, 3288 aa, Artificial Sequence
  derived and/or modified protein sequence (wt) from DENV-4__FJ850095__SS-prME
STITLLCLIPTVMAFHLSTRDGEPLMIVAKHERGRPLLFKTTEGINKCTLIAMDLGEMCEDTVTYKCPLLVNTEPEDIDCWCNLTSTWVMYGTCTQSGERRREKRSVALTPHSGMGLETRAETWMSSEGAWKHAQRVESWILRNPGFALLAGFMAYMIGQTGIQRTVFFVLMMLVAPSYGMRCVGVGNRDFVEGVSGGAWVDLVLEHGGCVTTMAQGKPTLDFELTKTTAKEVALLRTYCIEALISNITTATRCPTQGEPYLKEEQDQQYICRRDVVDRGWGNGCGLFGKGGVVTCAKFSCSGKITGNLVQIENLEYTVVVTVHNGDTHAVGNDTSNHGVTATITPRSPSVEVKLPDYGELTLDCEPRSGIDFNEMILMKMKKKTWLVHKQWFLDLPLPWTTGADTSEVHWNYKERMVTFKVPHAKRQDVTVLGSQEGAMHSALAGATEVDSGDGNHMFAGHLKCKVRMEKLRIKGMSYTMCSGKFSIDKEMAETQHGTTVVKVKYEGAGAPCKVPIEIRDVNKEKVVGRVISATPLAENTNSVTNIELEPPFGDSYIVIGVGNSALTLHWFRKGSSIGKMFESTYRGAKRMAILGETAWDFGSVGGLFTSLGKAVHQVFGSVYTTMFGGVSWMIRILIGFLVLWIGTNSRNTSMAMTCIAVGGITLFLGFTVQADMGCVVSWSGRELKCGSGIFVVDNVHTWTEQYKFQPESPARLASAILNAHKDGVCGIRSTTRLENVMWKQITNELNYVLWEGGHDLTVVAGDVKGVLTKGKRALTPPASDLKYSWKTWGKAKIFTPEARNSTFLIDGPDTSECPNERRAWNSFEVEDYGFGMFTTNIWMKFREGSSEVCDHRLMSAAIKDQKAVHADMGYWIESSKNQTWQIERASLIEVKTCLWPKTHTLWSNGVLESQMLIPKSYAGPFSQHNYRQGYATQTVGPWHLGKLEIDFGECPGTTVTIQEDCDHRGPSLRTTTASGKLVTQWCCRSCTMPPLRFLGEDGCWYGMEIRPLSEKEENMVKSQVTAGQGTSETFSMGLLCLTLFVEECLRRRVTRKHMILAVVITLCAIILGGLTWMDLLRALIMLGDTMSGRIGGQTHLAIMAVFKMSPGYVLGVFLRKLTSRETALMVIGMAMTTTLSIPHDLMELIDGISLGLILLKIVTQFDNTQVGTLALSLTFIRSTMSLVMAWRTIMAVLFVVTLIPLCRTSCLQKQSHWVEITALILGAQALPVYLMTLMKGASRRSWPLNEGIMAVGLVSLLGSALLKNDVPLAGPMVAGGLLLAAYVMSGSSADLSLEKAANVQWDEMADITGSSPIIEVKQDEDGSFSIRDVEETNMITLLVKLALITVSGLYPLAIPVTMTLWYMWQVKTQRSGALWDVPSPAATQKAALSEGVYRIMQRGLFGKTQVGVGIHMEGVFHTMWHVTRGSVICHETGRLEPSWADVRNDMISYGGGWRLGDKWDKEEDVQVLAIEPGKNPKHVQTKPGLFKTLTGEIGAVTLDFKPGTSGSPIINRKGKVIGLYGNGVVTKSGDYVSAITQAERIGEPDYEVDEDIFRKKRLTIMDLHPGAGKTKRILPSIVREALKRRLRTLILAPTRVVAAEMEEALRGLPIRYQTPAVKSEHTGREIVDLMCHATFTTRLLSSTRVPNYNLIVMDEAHFTDPSSVAARGYISTRVEMGEAAAIFMTATPPGATDPFPQSNSPIEDIEREIPERSWNTGFDWITDYQGKTVWFVPSIKAGNDIANCLRKSGKKVIQLSRKTFDTEYPKTKLTDWDFVVTTDISEMGANFRAGRVIDPRRCLKPVILTDGPERVILAGPIPVTPASAAQRRGRIGRNPAQEDDQYVFSGDPLKNDEDHAHWTEAKMLLDNIYTPEGIIPTLFGPEREKTQAIDGEFRLRGEQRKTFVELMRRGDLPVWLSYKVASAGISYKDREWCFTGERNNQILEENMEVEIWTREGEKKKLRPKWLDARVYADPMALKDFKEFASGRKSITLDILTEIASLPTYLSSRAKLALDNIVMLHTTERGGRAYQHALNELPESLETLMLVALLGAMTAGIFLFFMQGKGIGKLSMGLITIAVASGLLWVAEIQPQWIAASIILEFFLMVLLIPEPEKQRTPQDNQLIYVILTILTIIGLIAANEMGLIEKTKTDFGFYQVKTETTILDVDLRPASAWTLYAVATTILTPMLRHTIENTSANLSLAAIANQAAVLMGLGKGWPLHRMDLGVPLLAMGCYSQVNPTTLTASLVMLLVHYAIIGPGLQAKATREAQKRTAAGIMKNPTVDGITVIDLEPISYDPKFEKQLGQVMLLVLCAGQLLLMRTTWAFCEVLTLATGPILTLWEGNPGRFWNTTIAVSTANIFRGSYLAGAGLAFSLIKNAQTPRRGTGTTGETLGEKWKRQLNSLDRKEFEEYKRSGILEVDRTEAKSALKDGSKIKHAVSRGSSKIRWIVERGMVKPKGKVVDLGCGRGGWSYYMATLKNVTEVKGYTKGGPGHEEPIPMATYGWNLVKLHSGVDVFYKPTEQVDTLLCDIGESSSNPTIEEGRTLRVLKMVEPWLSSKPEFCIKVLNPYMPTVIEELEKLQRKHGGNLVRCPLSRNSTHEMYWVSGASGNIVSSVNTTSKMLLNRFTTRHRKPTYEKDVDLGAGTRSVSTETEKPDMTIIGRRLQRLQEEHKETWHYDQENPYRTWAYHGSYEAPSTGSASSMVNGVVKLLTKPWDVIPMVTQLAMTDTTPFGQQRVFKEKVDTRTPQPKPGTRMVMTTTANWLWALLGKKKNPRLCTREEFISKVRSNAAIGAVFQEEQGWTSASEAVNDSRFWELVDKERALHQEGKCESCVYNMMGKREKKLGEFGRAKGSRAIWYMWLGARFLEFEALGFLNEDHWFGRENSWSGVEGEGLHRLGYILEEIDKKDGDLMYADDTAGWDTRITEDDLQNEELITEQMAPHHKILAKAIFKLTYQNKVVKVLRPTPRGAVMDIISRKDQRGSGQVGTYGLNTFTNMEVQLIRQMEAEGVITQDDMQNPKGLKERVEKWLRECGVDRLKRMAISGDDCVVKPLDERFGTSLLFLNDMGKVRKDIPQWEPSKGWKNWQEVPFCSHHFHKIFMKDGRSLVVPCRNQDELIGRARISQGAGWSLRETACLGKAYAQMWSLMYFHRRDLRLASMAICSAVPTEWFPTSRTTWSIHAHHQWMTTEDMLKVWNRVWIEDNPNMIDKTPVHSWEDIPYLGKREDLWCGSLIGLSSRATWAKNIHTAITQVRNLIGKEEYVDYMPVMKRYSAPSESEGVL

SEQ ID NO: 5199 - protein, 3288 aa, Artificial Sequence
  derived and/or modified protein sequence (wt) from DENV-4__FJ639748__SS-prME
STMTLLCLIPTAMAFHLSTRDGEPLMIVAKHERGRPLLFKTTEGINKCTLIAMDLGEMCEDTVTYKCPLLVNTEPEDIDCWCNLTSTWVMYGTCTQSGERRREKRSVALTPHSGMGLETRAETWMSSEGAWKHAQRVESWILRNPGFALLAGFMAYMIGQTGIQRTVFFVLMMLVAPSYGMRCVGVGNRDFVEGVSGGAWVDLVLEHGGCVTTMAQGKPTLDFELTKTTAKEVALLRTYCIEALISNITTATRCPTQGEPYLKEEQDQQYICRRDVVDRGWGNGCGLFGKGGVVTCAKFSCSGKITGNLVQIENLEYTVVVTVHNGDTHAVGNDTSNHGVTATITPRSPSVEVQLPDYGELTLDCEPRSGIDFNEMILMKMKKKTWLVHKQWFLDLPLPWTAGADTSEVHWNYKERMVTFKVPHAKRQDVTVLGSQEGAMHSALAGATEVDSGDGNHMFAGHLKCKVRMEKLRIKGMSYTMCSGKFSIDKEMAETQHGTTVVKVKYEGAGAPCKVPIEIRDVNKEKVVGRVISSTPLAENTNSVTNIELEPPFGDSYIVIGVGNSALTLHWFRKGSSIGKMFESTYRGAKRMAILGETAWDFGSVGGLFTSLGKAVHQVFGSVYTTMFGGVSWMIRILIGLLVLWIGTNSRNTSMAMTCIAVGGITLFLGFTVQADVGCVVSWSGRELKCGSGIFVVDNVHTWTEQYKFQPESPARLASAILNAHKDGVCGIRSTTRLENVMWKQITNELNYVLWEGGHDLTVVAGDVKGVLTKGKRALTPPVSDLKYSWKTWGKAKIFTPEARNSTFLIDGPDTSECPNERRAWNSLEVEDYGFGMFTTNIWMKFREGSSEVCDHRLMSAAIKDQKAVHADMGYWIESSKNQTWQIERASLIEVKTCLWPKTHTLWSNGVLESQMLIPKSYAGPFSQHNYRQGYATQTVGPWHLGKLEIDFGECPGTTVTIQEDCDHRGPSLRTTTASGKLVTQWCCRSCTMPPLRFLGEDGCWYGMEIRPLSEKEENMVKSQVTAGQGTSETFSMGLLCLTLFVEECLRRRVTRKHMILAVVITLCAIILGGLTWMDLLRALIMLGDTMSGRIGGQTHLAIMAVFKMSPGYVLGVFLRKLTSRETALMVIGMAMTTTLSIPHDLMELIDGISLGLILLKIVTQFDNTQVGTLALSLTFIRSTMSLVMAWRTIMAVLFVVTLIPLCRTSCLQKQSHWVEITALILGAQALPVYLMTLMKGASRRSWPLNEGIMAVGLVSLLGSALLKNDVPLAGPMVAGGLLLAAYVMSGSSADLSLEKAANVQWDEMADITGSSPIIEVKQDEDGSFSIRDVEETNMITLLVKLALITVSGLYPLAIPVTMTLWYMWQVKTQRSGALWDVPSPAATQKAALSEGVYRIMQRGLFGKTQVGVGIHMEGVFHTMWHVTRGSVICHETGRLEPSWADVRNDMISYGGGWRLGDKWDKEEDVQVLAIEPGKNPKHVQTKPGLFKTLTGEIGAVTLDFKPGTSGSPIINRKGKVIGLYGNGVVTKSGDYVSAITQAERIGEPDYEVDEDIFRKKRLTIMDLHPGAGKTKRILPSIVREALKRRLRTLILAPTRVVAAEMEEALRGLPIRYQTPAVKSEHTGREIVDLMCHATFTTRLLSSTRVPNYNLIVMDEAHFTDPSSVAARGYISTRVEMGEAAAIFMTATPPGATDPFPQSNSPIEDIEREIPERSWNTGFDWITDYQGKTVWFVPSIKAGNDIANCLRKSGKKVIQLSRKTFDTEYPKTKLTDWDFVVTTDISEMGANFRAGRVIDPRRCLKPVILTDGPERVILAGPIPVTPASAAQRRGRIGRNPAQEDDQYVFSGDPLKNDEDHAHWTEAKMLLDNIYTPEGIIPTLFGPEREKTQAIDGEFRLRGEQRKTFVELMRRGDLPVWLSYKVASAGISYKDREWCFTGERNNQILEENMEVEIWTREGEKKKLRPRWLDARVYADPMALKDFKEFASGRKSITLDILTEIASLPTYLSSRAKLALDNIVMLHTTERGGRAYQHALNELPESLETLMLVALLGAMTAGIFLFFMQGKGIGKLSMGLITIAVASGLLWVAEIQPQWIAASIILEFFLMVLLIPEPEKQRTPQDNQLIYVILTILTIIGLIAANEMGLIEKTKTDFGFYQVKTETTILDVDLRPASAWTLYAVATTILTPMLRHTIENTSANLSLAAIANQAAVLMGLGKGWPLHRMDLGVPLLAMGCYSQVNPTTLTASLVMLLVHYAIIGPGLQAKATREAQKRTAAGIMKNPTVDGITVIDLEPISYDPKFEKQLGQVMLLVLCAGQLLLMRTTWAFCEVLTLATGPILTLWEGNPGRFWNTTIAVSTANIFRGSYLAGAGLAFSLIKNAQTPRRGTGTTGETLGEKWKRQLNSLDRKEFEEYKRSGILEVDRTEAKSALKDGSKIKHAVSRGSSKIRWIVERGMVKPKGKVVDLGCGRGGWSYYMATLKNVTEVKGYTKGGPGHEEPIPMATYGWNLVKLHSGVDVFYKPTEQVDTLLCDIGESSSNPTIEEGRTLRVLKMVEPWLSSKPEFCIKVLNPYMPTVIEELEKLQRKHGGNLVRCPLSRNSTHEMYWVSGASGNIVSSVNTTSKMLLNRFTTRHRKPTYEKDVDLGAGTRSVSTETEKPDMTIIGRRLQRLQEEHKETWHYDQENPYRTWAYHGSYEAPSTGSASSMVNGVVKLLTKPWDVIPMVTQLAMTDTTPFGQQRVFKEKVDTRTPQSKPGTRMVMTTTANWLWALLGKKKNPRLCTREEFISKVRSNAAIGAVFQEEQGWTSASEAVNDSRFWELVDKERALHQEGKCESCVYNMMGKREKKLGEFGRAKGSRAIWYMWLGARFLEFEALGFLNEDHWFGRENSWSGVEGEGLHRLGYILEEIDKKDGDLMYADDTAGWDTRITEDDLQNEELITEQMAPHHKILAKAIFKLTYQNKVVKVLRPTPRGAVMDIISRKDQRGSGQVGTYGLNTFTNMEVQLIRQMEAEGVITQDDMQNPKGLKERVEKWLRECGVDRLKRMAISGDDCVVKPLDERFATSLLFLNDMGKVRKDIPQWEPSKGWKNWQEVPFCSHHFHKIFMKDGRSLVVPCRNQDELIGRARISQGAGWSLRETACLGKAYAQMWSLMYFHRRDLRLASMAICSAVPTEWFPTSRTTWSIHAHHQWMTTEDMLKVWNRVWIEDNPNMIDKTPVHSWEDIPYLGKREDLWCGSLIGLSSRATWAKNIHTAITQVRNLIGKEEYVDYMPVMKRYSAPSENEGVL

SEQ ID NO: 5200 - protein, 3288 aa, Artificial Sequence
  derived and/or modified protein sequence (wt) from DENV-4__FJ639764__SS-prME
STITLLCLIPTVMAFHLSTRDGEPLMIVAKHERGRPLLFKTTEGTNKCTLIAMDLGEMCEDTVTYKCPLLVNTEPEDIDCWCNLTSTWVMYGTCTQSGERRREKRSVALTPHSGMGLETRAETWMSSEGAWKHAQRVESWILRNPGFALLAGFMAYMIGQTGIQRTVFFVLMMLVAPSYGMRCVGVGNRDFVEGVSGGAWVDLVLEHGGCVTTMAQGKPTLDFELTKTTAKEVALLRTYCIEALISNITTATRCPTQGEPYLKEEQDQQYICRRDVVDRGWGNGCGLFGKGGVVTCAKFSCSGKITGNLVQIENLEYTVVVTVHNGDTHAVGNDTSNHGVTATITPRSPSVEVKLPDYGELTLDCEPRSGIDFNEMILMKMKKKTWLVHKQWFLDLPLPWTAGADTSEVHWNYKERMVTFKVPHAKRQDVTVLGSQEGAMHSALAGATEVDSGDGNHMFAGHLKCKVRMEKLRIKGMSYTMCSGKFSIDKEMAETQHGTTVVKVKYEGAGAPCKVPIEIRDVNKEKVVGRVISSTPLAENTNSVTNIELEPPFGDSYIVIGVGNSALTLHWFRKGSSIGKMFESTYRGAKRMAILGETAWDFGSVGGLFTSLGKAVHQVFGSVYTTMFGGVSWMIRILIGFLVLWIGTNSRNTSMAMTCIAVGGITLFLGFTVQADMGCVVSWSGRELKCGSGIFVVDNVHTWIEQYKFQPESPARLASAILNAHKDGVCGIRSTTRLENVMWKQITNELNYVLWEGGHDLTVVAGDVKGVLTKGKRTLTPPVSDLKYSWKTWGKAKIFTPEARNSTFLIDGPDTSECPNERRAWNSLEVEDYGFGMFTTNIWMKFREGSSEVCDHRLMSAAIKDQKAVHADMGYWIESSKNQTWQIERASLIEVKTCLWPKTHTLWSNGVLESQMLIPKSYAGPFSQHNYRQGYATQTVGPWHLGKLEIDFGECPGTTVTIQEDCDHRGPSLRTTTASGKLVTQWCCRSCTMPPLRFLGEDGCWYGMEIRPLSEKEENMVKSQVTAGQGTSETFSMGLLCLTLFVEECLRRRVTRKHMILAVVITLCAIILGGLTWMDLLRALIMLGDTMSGRIGGQTHLAIMAVFKMSPGYVLGVFLRRLTSRETALMVIGMAMTTTLSIPHDLMELIDGISLGLILLKIVTQFDNTQVGTLALSLTFIRSTMSLVMAWRTIMAVLFVVTLIPLCRTSCLQKQSHWVEITALILGAQALPVYLMTLMKGASRRSWPLNEGIMAVGLVSLLGSALLKNDVPLAGPMVAGGLLLAAYVMSGSSADLSLEKAANVQWDEMADITGSSPIIEVKQDEDGSFSIRDVEETNMITLLVKLALITVSGLYPLAIPVTMTLWYMWQVKTQRSGALWDVPSPAATQKAALSEGVYRIMQRGLFGKTQVGVGIHMEGVFHTMWHVTRGSVICHETGRLEPSWADVRNDMISYGGGWRLGDKWDKEEDVQVLAVEPGKNPKHVQTKPGLFKTITGEIGAVTLDFKPGTSGSPIINRKGKVIGLYGNGVVTKSGDYVSAITQAERIGEPDYEVDEDIFRKKRLTIMDLHPGAGKTKRILPSIVREALKRRLRTLILAPTRVVAAEMEEALRGLPIRYQTPAVKSEHTGREIVDLMCHATFTTRLLSSTRVPNYNLIVMDEAHFTDPSSVAARGYISTRVEMGEAAAIFMTATPPGATDPFPQSNSPIEDIEREIPERSWNTGFDWITDYQGKTVWFVPSIKAGNDIANCLRKSGKKVIQLSRKTFDTEYPKTKLTDWDFVVTTDISEMGANFRAGRVIDPRRCLKPVILTDGPERVILAGPIPVTPASAAQRRGRIGRNPAQEDDQYVFSGDPLKNDEDHAHWTEAKMLLDNIYTPEGIIPTLFGPEREKTQAIDGEFRLRGEQRKTFVELMRRGDLPVWLSYKVASAGISYKDREWCFTGERNNQILEENMEVEIWTREGEKKKLRPRWLDARVYADPMALKDFKEFASGRKSITLDILTEIASLPTYLSSRAKLALDNIVMLHTTERGGRAYQHALNELPESLETLMLVALLGAMTAGIFLFFMQGKGIGKLSMGLITIAVASGLLWVAEIQPQWIAASIILEFFLMVLLIPEPEKQRTPQDNQLIYVILTILTIIGLIAANEMGLIEKTKTDFGFYQVKTETTILDVDLRPASAWTLYAVATTILTPMLRHTIENTSANLSLAAIANQAAVLMGLGKGWPLHRMDLGVPLLAMGCYSQVNPTTLTASLVMLLVHYAIIGPGLQAKATREAQKRTAAGIMKNPTVDGITVIDLEPISYDPKFEKQLGQVMLLVLCAGQLLLMRTTWAFCEVLTLATGPILTLWEGNPGRFWNTTIAVSTANIFRGSYLAGAGLAFSLIKNAQTPRRGTGTTGETLGEKWKRQLNSLDRKEFEEYKRSGILEVDRTEAKSALKDGSKIKHAVSRGSSKIRWIVERGMVKPKGKVVDLGCGRGGWSYYMATLKNVTEVKGYTKGGPGHEEPIPMATYGWNLVKLHSGVDVFYKPTEQVDTLLCDIGESSSNPTIEEGRTLRVLKMVEPWLSSKPEFCIKVLNPYMPTVIEELEKLQRKHGGNLVRCPLSRNSTHEMYWVSGASGNIVSSVNTTSKMLLNRFTTRHRKPTYEKDVDLGAGTRSVSTETEKPDMTIIGRRLQRLQEEHKETWHYDQENPYRTWAYHGSYEAPSTGSASSMVNGVVKLLTKPWDVIPMVTQLAMTDTTPFGQQRVFKEKVDTRTPQPKPGTRMVMTTTANWLWALLGKKKNPRLCTREEFISKVRSNAAIGAVFQEEQGWTSASEAVNDSRFWELVDKERALHQEGKCESCVYNMMGKREKKLGEFGRAKGSRAIWYMWLGARFLEFEALGFLNEDHWFGRENSWSGVEGEGLHRLGYILEEIDKKDGDLMYADDTAGWDTRITEDDLQNEELITEQMAPHHKILAKAIFKLTYQNKVVKVLRPTPRGAVMDIISRKDQRGSGQVGTYGLNTFTNMEVQLIRQMEAEGVITQDDMQNPKGLKERVEKWLRECGVDRLKRMAISGDDCVVKPLDERFGTSLLFLNDMGKVRKDIPQWEPSKGWKNWQEVPFCSHHFHKIFMKDGRSLVVPCRNQDELIGRARISQGAGWSLRETACLGKAYAQMWSLMYFHRRDLRLASMAICSAVPTEWFPTSRTTWSIHAHHQWMTTEDMLKVWNRVWIEDNPNMIDKTPVHSWEDIPYLGKREDLWCGSLIGLSSRATWAKNIHTAITQVRNLIGKEEYVDYMPVMKRYSAPSESEGVL

SEQ ID NO: 5201 - protein, 3288 aa, Artificial Sequence
  derived and/or modified protein sequence (wt) from DENV-4__FJ639773__SS-prME
STITLLCLIPTVMAFHLSTRDGEPLMIVAKHERGRPLLFKTTEGINKCTLIAMDLGEMCEDTVTYKCPLLVNTEPEDIDCWCNLTSTWVMYGTCTQSGERRREKRSVALTPHSGMGLETRAETWMSSEGAWKHAQRVESWILRNPGFALLAGFMAYMIGQTGIQRTVFFVLMMLVAPSYGMRCVGVGNRDFVEGVSGGAWVDLVLEHGGCVTTMAQGKPTLDFELTKTTAKEVALLRTYCIEALISNITTATRCPTQGEPYLKEEQDQQYICRRDVVDRGWGNGCGLFGKGGVVTCAKFSCSGKITGNLVQIENLEYTVVVTVHNGDTHAVGNDTSNHGVTATITPRSPSVEVKLPDYGELTLDCEPRSGIDFNEMILMKMKKKTWLVHKQWFLDLPLPWTTGADTSEVHWNYKERMVTFKVPHAKRQDVTVLGSQEGAMHSALAGATEVDSGDGNHMFAGHLKCKVRMERLRIKGMSYTMCSGKFSIDKEMAETQHGTTVVKVKYEGAGAPCKVPIEIRDVNKEKVVGRVISATPLAENTNSVTNIELEPPFGDSYIVIGVGNSALTLHWFRKGSSIGKMFESTYRGAKRMAILGETAWDFGSVGGLFTSLGKAVHQVFGSVYTTMFGGVSWMIRILIGFLVLWIGTNSRNTSMAMTCIAVGGITLFLGFTVQADMGCVVSWSGRELKCGSGIFVVDNVHTWTEQYKFQPESPARLASAILNAHKDGVCGIRSTTRLENVMWKQITNELNYVLWEGGHDLTVVAGDVKGVLTKGKRALTPPASDLKYSWKTWGKAKIFTPEARNSTFLIDGPDTSECPNERRAWNSFEVEDYGFGMFTTNIWMKFREGSSEVCDHRLMSAAIKDQKAVHADMGYWIESSKNQTWQIERASLIEVKTCLWPKTHTLWSNGVLESQMLIPKSYAGPFSQHNYRQGYATQTVGPWHLGKLEIDFGECPGTTVTIQEDCDHRGPSLRTTTASGKLVTQWCCRSCTMPPLRFLGEDGCWYGMEIRPLSEKEENMVKSQVTAGQGTSETFSMGLLCLTLFVEECLRRRVTRKHMILAVVITLCAIILGGLTWMDLLRALIMLGDTMSGRIGGQTHLAIMAVFKMSPGYVLGVFLRKLTSRETALMVIGMAMTTTLSIPHDLMELIDGISLGLILLKIVTQFDNTQVGTLALSLTFIRSTMSLVMAWRTIMAVLFVVTLIPLCRTSCLQKQSHWVEITALILGAQALPVYLMTLMKGASRRSWPLNEGIMAVGLVSLLGSALLKNDVPLAGPMVAGGLLLAAYVMSGSSADLSLEKAANVQWDEMADITGSSPIIEVKQDEDGSFSIRDVEETNMITLLVKLALITVSGLYPLAIPVTMTLWYMWQVKTQRSGALWDVPSPATTQKAALSEGVYRIMQRGLFGKTQVGVGIHMEGVFHTMWHVTRGSVICHETGRLEPSWADVRNDMISYGGGWRLGDKWDKEEDVQVLAIEPGKNPKHVQTKPGLFKTLTGEIGAVTLDFKPGTSGSPIINRKGKVIGLYGNGVVTKSGDYVSAITQAERIGEPDYEVDEDIFRKKRLTIMDLHPGAGKTKRILPSIVREALKRRLRTLILAPTRVVAAEMEEALRGLPIRYQTPAVKSEHTGREIVDLMCHATFTTRLLSSTRVPNYNLIVMDEAHFTDPSSVAARGYISTRVEMGEAAAIFMTATPPGATDPFPQSNSPIEDIEREIPERSWNTGFDWITDYQGKTVWFVPSIKAGNDIANCLRKSGKKVIQLSRKTFDTEYPKTKLTDWDFVVTTDISEMGANFRAGRVIDPRRCLKPVILTDGPERVILAGPIPVTPASAAQRRGRIGRNPAQEDDQYVFSGDPLKNDEDHAHWTEAKMLLDNIYTPEGIIPTLFGPEREKTQAIDGEFRLRGEQRKTFVELMRRGDLPVWLSYKVASAGISYKDREWCFTGERNNQILEENMEVEIWTREGEKKKLRPKWLDARVYADPMALKDFKEFASGRKSITLDILTEIASLPTYLSSRAKLALDNIVMLHTTERGGRAYQHALNELPESLETLMLVALLGAMTAGIFLFFMQGKGIGKLSMGLITIAVASGLLWVAEIQPQWIAASIILEFFLMVLLIPEPEKQRTPQDNQLIYVILTILTIIGLIAANEMGLIEKTKTDFGFYQEKTETTILDVDLRPASAWTLYAVATTILTPMLRHTIENTSANLSLAAIANQAAVLMGLGKGWPLHRMDLGVPLLAMGCYSQVNPTTLTASLVMLLVHYAIIGPGLQAKATREAQKRTAAGIMKNPTVDGITVIDLEPISYDPKFEKQLGQVMLLVLCAGQLLLMRTTWAFCEVLTLATGPILTLWEGNPGRFWNTTIAVSTANIFRGSYLAGAGLAFSLIKNAQTPRRGTGTTGETLGEKWKRQLNSLDRKEFEEYKRSGILEVDRTEAKSALKDGSKIKHAVSRGSSKIRWIVERGMVKPKGKVVDLGCGRGGWSYYMATLKNVTEVKGYTKGGPGHEEPIPMATYGWNLVKLHSGVDVFYKPTEQVDTLLCDIGESSSNPTIEEGRTLRVLKMVEPWLSSKPEFCIKVLNPYMPTVIEELEKLQRKHGGNLVRCPLSRNSTHEMYWVSGASGNIVSSVNTTSKMLLNRFTTRHRKPTYEKDVDLGAGTRSVSTETEKPDMTIIGRRLQRLQEEHKETWHYDQENPYRTWAYHGSYEAPSTGSASSMVNGVVKLLTKPWDVIPMVTQLAMTDTTPFGQQRVFKEKVDTRTPQPKPGTRMVMTTTANWLWALLGKKKNPRLCTREEFISKVRSNAAIGAVFQEEQGWTSASEAVNDSRFWELVDKERALHQEGKCESCVYNMMGKREKKLGEFGRAKGSRAIWYMWLGARFLEFEALGFLNEDHWFGRENSWSGVEGEGLHRLGYILEEIDKKDGDLMYADDTAGWDTRITEDDLQNEELITEQMAPHHKILAKAIFKLTYQNKVVKVLRPTPRGAVMDIISRKDQRGSGQVGTYGLNTFTNMEVQLIRQMEAEGVITQDDMQNPKGLKERVEKWLRECGVDRLKRMAISGDDCVVKPLDERFGTSLLFLNDMGKVRKDIPQWEPSKGWKNWQEVPFCSHHFHKIFMKDGRSLVVPCRNQDELIGRARISQGAGWSLRETACLGKAYAQMWSLMYFHRRDLRLASMAICSAVPTEWFPTSRTTWSIHAHHQWMTTEDMLKVWNRVWIEDNPNMIDKTPVHSWEDIPYLGKREDLWCGSLIGLSSRATWAKNIHTAITQVRNLIGKEEYVDYMPVMKRYSAPSESEGVL

SEQ ID NO: 5202 - protein, 3288 aa, Artificial Sequence
  derived and/or modified protein sequence (wt) from DENV-4__FJ882580__SS-prME
STITLLCLIPTVMAFHLSTRDGEPLMIVAKHERGRPLLFKTTEGINKCTLIAMDLGEMCEDTVTYKCPLLVNTEPEDIDCWCNLTSTWVMYGTCTQSGERRREKRSVALTPHSGMGLETRAETWMSSEGAWKHAQRVESWILRNPGFALLAGFMAYMIGQTGIQRTVFFVLMMLVAPSYGMRCVGVGNRDFVEGVSGGAWVDLVLEHGGCVTTMAQGKPTLDFELTKTTAKEVALLRTYCIEALISNITTATRCPTQGEPYLKEEQDQQYICRRDVVDRGWGNGCGLFGKGGVVTCAKFSCSGKITGNLVQIENLEYTVVVTVHNGDTHAVGNDTSNHGVTATITPRSPSVEVKLPDYGELTLDCEPRSGIDFNEMILMKMKKKTWLVHKQWFLDLPLPWTTGADTSEVHWNYKERMVTFKVPHAKRQDVTVLGSQEGAMHSALAGATEVDSGDGNHMFAGHLKCKVRMEKLRIKGMSYTMCSGKFSIDKEMAETQHGTTVVKVKYEGAGAPCKVPIEIRDVNKERVVGRVISATPLAENTNSVTNIELEPPFGDSYIVIGVGNSALTLHWFRKGSSIGKMFESTYRGAKRMAILGETAWDFGSVGGLFTSLGKAVHQVFGSVYTTMFGGVSWMIRILIGFLVLWIGTNSRNTSMAMTCIAVGGITLFLGFTVQADMGCVVSWSGRELKCGSGIFVVDNVHTWTEQYKFQPESPARLASAILNAHKDGVCGIRSTTRLENVMWKQITNELNYVLWEGGHDLTIVAGDVKGVLTKGKRALTPPASDLKYSWKTWGKAKIFTPEARNSTFLIDGPDTSECPNERRAWNSFEVEDYGFGMFTTNIWMKFREGSSEVCDHRLMSAAIKDQKAVHADMGYWIESSKNQTWQIERASLIEVKTCLWPKTHTLWSNGVLESQMLIPKSYAGPFSQHNYRQGYATQTVGPWHLGKLEIDFGECPGTTVTIQENCDHRGPSLRTTTASGKLVTQWCCRSCTMPPLRFLGEDGCWYGMEIRPLSEKEENMVKSQVTAGQGTSETFSMGLLCLTLFVEECLRRRVTRKHMILAVVITLCAIILGGLTWMDLLRALIMLGDTMSGRIGGQTHLAIMAVFKMSPGYVLGVFLRKLTSRETALMVIGMAMTTTLSIPHDLMELIDGISLGLILLKIVTQFDNTQVGTLALSLTFIRSTMSLVMAWRTIMAVLFVVTLIPLCRTSCLQKQSHWVEITALILGAQALPVYLMTLMKGASRRSWPLNEGIMAVGLVSLLGSALLKNDVPLAGPMVAGGLLLAAYVMSGSSADLSLEKAANVQWDEMADITGSSPIIEVKQDEDGSFSIRDVEETNMITLLVKLALITVSGLYPLAIPITMTLWYMWQVKTQRSGALWDVPSPAATQKAALSEGVYRIMQRGLFGKTQVGVGIHMEGVFHTMWHVTRGSVICHETGRLEPSWADVRNDMISYGGGWRLGDKWDKEEDVQVLAIEPGKNPKHVQTKPGLFKTLTGEIGAVTLDFKPGTSGSPIINRKGKVIGLYGNGVVTKSGDYVSAITQAERIGEPDYEVDEDIFRKKRLTIMDLHPGAGKTKRILPSIVREALKRRLRTLILAPTRVVAAEMEEALRGLPIRYQTPAVKSEHTGREIVDLMCHATFTTRLLSSTRVPNYNLIVMDEAHFTDPSSVAARGYISTRVEMGEAAAIFMTATPPGATDPFPQSNSPIEDIEREIPERSWNTGFDWITDYQGKTVWFVPSIKAGNDIANCLRKSGKKVIQLSRKTFDTEYPKTKLTDWDFVVTTDISEMGANFRAGRVIDPRRCLKPVILTDGPERVILAGPIPVTPASAAQRRGRIGRNPAQEDDQYVFSGDPLKNDEDHAHWTEAKMLLDNIYTPEGIIPTLFGPEREKTQAIDGEFRLRGEQRKTFVELMRRGDLPVWLSYKVASAGISYKDREWCFTGERNNQILEENMEVEIWTREGEKKKLRPKWLDARVYADPMALKDFKEFASGRKSITLDILTEIASLPTYLSSRAKLALDNIVMLHTTERGGRAYQHALNELPESLETLMLVALLGAMTAGIFLFFMQGKGIGKLSMGLITIAVASGLLWVAEIQPQWIAASIILEFFLMVLLIPEPEKQRTPQDNQLIYVILTILTIIGLIAANEMGLIEKTKTDFGFYQVKTETTILDVDLRPASAWTLYAVATTILTPMLRHTIENTSANLSLAAIANQAAVLMGLGKGWPLHRMDLGVPLLAMGCYSQVNPTTLTASLVMLLVHYAIIGPGLQAKATREAQKRTAAGIMKNPTVDGITVIDLEPISYDPKFEKQLGQVMLLVLCAGQLLLMRTTWAFCEVLTLATGPILTLWEGNPGRFWNTTIAVSTANIFRGSYLAGAGLAFSLIKNAQTPRRGTGTTGETLGEKWKRQLNSLDRKEFEEYKRSGILEVDRTEAKSALKDGSKIKHAVSRGSSKIRWIVERGMVKPKGKVVDLGCGRGGWSYYMATLKNVTEVKGYTKGGPGHEEPIPMATYGWNLVKLHSGVDVFYKPTEQVDTLLCDIGESSSNPTIEEGRTLRVLKMVEPWLSSKPEFCIKVLNPYMPTVIEELEKLQRKHGGNLVRCPLSRNSTHEMYWVSGASGNIVSSVNTTSKMLLNRFTTRHRKPTYEKDVDLGAGTRSVSTETEKPDMTIIGRRLQRLQEEHKETWHYDQENPYRTWAYHGSYEAPSTGSASSMVNGVVKLLTKPWDVIPMVTQLAMTDTTPFGQQRVFKEKVDTRTPQPKPGTRMVMTTTANWLWALLGKKKNPRLCTREEFISKVRSNAAIGAVFQEEQGWTSASEAVNDSRFWELVDKERALHQEGKCESCVYNMMGKREKKLGEFGRAKGSRAIWYMWLGARFLEFEALGFLNEDHWFGRENSWSGVEGEGLHRLGYILEEIDKKDGDLMYADDTAGWDTRITEDDLQNEELITEQMAPHHKILAKAIFKLTYQNKVVKVLRPTPRGAVMDIISRKDQRGSGQVGTYGLNTFTNMEVQLIRQMEAEGVITQDDMQNPKGLKERVEKWLRECGVDRLKRMAISGDDCVVKPLDERFGTSLLFLNDMGKVRKDIPQWEPSKGWKNWQEVPFCSHHFHKIFMKDGRSLVVPCRNQDELIGRARISQGAGWSLRETACLGKAYAQMWSLMYFHRRDLRLASMAICSAVPTEWFPTSRTTWSIHAHHQWMTTEDMLKVWNRVWIEDNPNMIDKTPVHSWEDIPYLGKREDLWCGSLIGLSSRATWAKNIHTAITQVRNLIGKEEYVDYMPVMKRYSAPSESEGVL

SEQ ID NO: 5203 - protein, 3288 aa, Artificial Sequence
  derived and/or modified protein sequence (wt) from DENV-4__FJ882581__SS-prME
STITLLCLIPTVMAFHLSTRDGEPLMIVAKHERGRPLLFKTTEGINKCTLIAMDLGEMCEDTVTYKCPLLVNTEPEDIDCWCNLTSTWVMYGTCTQSGERRREKRSVALTPHSGMGLETRAETWMSSEGAWKHAQRVESWILRNPGFALLAGFMAYMIGQTGIQRTVFFVLMMLVAPSYGMRCVGVGNRDFVEGVSGGAWVDLVLEHGGCVTTMAQGKPTLDFELTKTTAKEVALLRTYCIEALISNITTATRCPTQGEPYLKEEQDQQYICRRDVVDRGWGNGCGLFGKGGVVTCAKFSCSGKITGNLVQIENLEYTVVVTVHNGDTHAVGNDTSNHGVTATITPRSPSVEVKLPDYGELTLDCEPRSGIDFNEMILMKMKKKTWLVHKQWFLDLPLPWTTGADTSEVHWNYKERMVTFKVPHAKRQDVTVLGSQEGAMHSALAGATEVDSGDGNHMFAGHLKCKVRMEKLRIKGMSYTMCSGKFSIDKEMAETQHGTTVVKVKYEGAGAPCKVPIEIRDVNKEKVVGRVISATPLAENTNSVTNIELEPPFGDSYIVIGVGNSALTLHWFRKGSSIGKMFESTYRGAKRMAILGETAWDFGSVGGLFTSLGKAVHQVFGSVYTTMFGGVSWMIRILIGFLVLWIGTNSRNTSMAMTCIAVGGITLFLGFTVQADMGCVVSWNGRELKCGSGIFVVDNVHTWTEQYKFQPESPARLASAILNAHKDGVCGIRSTTRLENVMWKQITNELNYVLWEGGHDLTVVAGDVKGVLTKGKRALTPPASDLKYSWKTWGKAKIFTPEARNSTFLIDGPDTSECPNERRAWNSFEVEDYGFGMFTTNIWMKFREGSSEVCDHRLMSAAIKDQKAVHADMGYWIESSKNQTWQIERASLIEVKTCLWPKTHTLWSNGVLESQMLIPKSYAGPFSQHNYRQGYATQTVGPWHLGKLEIDFGECPGTTVTIQENCDHRGPSLRTTTASGKLVTQWCCRSCTMPPLRFLGEDGCWYGMEIRPLSEKEENMVKSQVTAGQGTSETFSMGLLCLTLFVEECLRRRVTRKHMILAVVITLCAIILGGLTWMDLLRALIMLGDTMSGRIGGQTHLAIMAVFKMSPGYVLGVFLRKLTSRETALMVIGMAMTTTLSIPHDLMELIDGISLGLILLKIVTQFDNTQVGTLALSLTFIRSTMSLVMAWRTIMAVLFVVTLIPLCRTSCLQKQSHWVEITALILGAQALPVYLMTLMKGASRRSWPLNEGIMAVGLVSLLGSALLKNDVPLAGPMVAGGLLLAAYVMSGSSADLSLEKAANVQWDEMADITGSSPIIEVKQDEDGSFSIRDVEETNMITLLVKLALITVSGLYPLAIPITMTLWYMWQVKTQRSGALWDVPSPAATQKAALSEGVYRIMQRGLFGKTQVGVGIHMEGVFHTMWHVTRGSVICHETGRLEPSWADVRNDMISYGGGWRLGDKWDKEEDVQVLAIEPGKNPKHVQTKPGLFKTLTGEIGAVTLDFKPGTSGSPIINRKGKVIGLYGNGVVTKSGDYVSAITQAERIGEPDYEVDEDIFRKKRLTIMDLHPGAGKTKRILPSIVREALKRRLRTLILAPTRVVAAEMEEALRGLPIRYQTPAVKSEHTGREIVDLMCHATFTTRLLSSTRVPNYNLIVMDEAHFTDPSSVAARGYISTRVEMGEAAAIFMTATPPGATDPFPQSNSPIEDIEREIPERSWNTGFDWITDYQGKTVWFVPSIKAGNDIANCLRKSGKKVIQLSRKTFDTEYPKTKLTDWDFVVTTDISEMGANFRAGRVIDPRRCLKPVILTDGPERVILAGPIPVTPASAAQRRGRIGRNLAQEDDQYVFSGDPLKNDEDHAHWTEAKMLLDNIYTPEGIIPTLFGPEREKTQAIDGEFRLRGEQRKTFVELMRRGDLPVWLSYKVASAGISYKDREWCFTGERNNQILEENMEVEIWTREGEKKKLRPKWLDARVYADPMALKDFKEFASGRKSITLDILTEIASLPTYLSSRAKLALDNIVMLHTTERGGRAYQHALNELPESLETLMLVALLGAMTAGIFLFFMQGKGIGKLSMGLITIAVASGLLWVAEIQPQWIAASIILEFFLMVLLIPEPEKQRTPQDNQLIYVILTILTIIGLIAANEMGLIEKTKTDFGFYQVKTETTILDVDLRPASAWTLYAVATTILTPMLRHTIENTSANLSLAAIANQAAVLMGLGKGWPLHRMDLGVPLLAMGCYSQVNPTTLTASLVMLLVHYAIIGPGLQAKATREAQKRTAAGIMKNPTVDGITVIDLEPISYDPKFEKQLGQVMLLVLCAGQLLLMRTTWAFCEVLTLATGPILTLWEGNPGRFWNTTIAVSTANIFRGSYLAGAGLAFSLIKNAQTPRRGTGTTGETLGEKWKRQLNSLDRKEFEEYKRSGILEVDRTEAKSALKDGSKIKHAVSRGSSKIRWIVERGMVKPKGKVVDLGCGRGGWSYYMATLKNVTEVKGYTKGGPGHEEPIPMATYGWNLVKLHSGVDVFYKPTEQVDTLLCDIGESSSNPTIEEGRTLRVLKMVEPWLSSKPEFCIKVLNPYMPTVIEELEKLQRKHGGNLVRCPLSRNSTHEMYWVSGASGNIVSSVNTTSKMLLNRFTTRHRKPTYEKDVDLGAGTRSVSTETEKPDMTIIGRRLQRLQEEHKETWHYDQENPYRTWAYHGSYEAPSTGSASSMVNGVVKLLTKPWDVIPMVTQLAMTDTTPFGQQRVFKEKVDTRTPQPKPGTRMVMTTTANWLWALLGKKKNPRLCTREEFISKVRSNAAIGAVFQEEQGWTSASEAVNDSRFWELVDKERALHQEGKCESCVYNMMGKREKKLGEFGRAKGSRAIWYMWLGARFLEFEALGFLNEDHWFGRENSWSGVEGEGLHRLGYILEEIDKKDGDLMYADDTAGWDTRITEDDLQNEELITEQMAPHHKILAKAIFKLTYQNKVVKVLRPTPRGAVMDIISRKDQRGSGQVGTYGLNTFTNMEVQLIRQMEAEGVITQDDMQNPKGLKERVEKWLRECGVDRLKRMAISGDDCVVKPLDERFGTSLLFLNDMGKVRKDIPQWEPSKGWKNWQEVPFCSHHFHKIFMKDGRSLVVPCRNQDELIGRARISQGAGWSLRETACLGKAYAQMWSLMYFHRRDLRLASMAICSAVPTEWFPTSRTTWSIHAHHQWMTTEDMLKVWNRVWIEDNPNMIDKTPVHSWEDIPYLGKREDLWCGSLIGLSSRATWAKNIHTAITQVRNLIGKEEYVDYMPVMKRYSAPSESEGVL

SEQ ID NO: 5204 - protein, 3288 aa, Artificial Sequence
  derived and/or modified protein sequence (wt) from DENV-4__FJ882582__SS-prME
STITLLCLIPTVMAFHLSTRDGEPLMIVAKHERGRPLLFKTTEGINKCTLIAMDLGEMCEDTVTYKCPLLVNTEPEDIDCWCNLTSTWVMYGTCTQSGERRREKRSVALTPHSGMGLETRAETWMSSEGAWKHAQRVESWILRNPGFALLAGFMAYMIGQTGIQRTVFFVLMMLVAPSYGMRCVGVGNRDFVEGVSGGAWVDLVLEHGGCVTTMAQGKPTLDFELTKTTAKEVALLRTYCIEALISNITTATRCPTQGEPYLKEEQDQQYICRRDVVDRGWGNGCGLFGKGGVVTCAKFSCSGKITGNLVQIENLEYTVVVTVHNGDTHAVGNDTSNHGVTATITPRSPSVEVKLPDYGELTLDCEPRSGIDFNEMILMKMKKKTWLVHKQWFLDLPLPWTTGADTSEVHWNYKERMVTFKVPHAKRQDVTVLGSQEGAMHSALAGATEVDSGDGNHMFAGHLKCKVRMEKLRIKGMSYTMCSGKFSIDKEMAETQHGTTVVKVKYEGAGAPCKVPIEIRDVNKEKVVGRVISATPLAENTNSVTNIELEPPFGDSYIVIGVGNSALTLHWFRKGSSIGKMFESTYRGAKRMAILGETAWDFGSVGGLFTSLGKAVHQVFGSVYTTMFGGVSWMIRILIGFLVLWIGTNSRNTSMAMTCIAVGGITLFLGFTVQADMGCVVSWNGRELKCGSGIFVVDNVHTWTEQYKFQPESPARLASAILNAHKDGVCGIRSTTRLENVMWKQITNELNYVLWEGGHDLTVVAGDVKGVLTKGKRALTPPASDLKYSWKTWGKAKIFTPEARNSTFLIDGPDTSECPNERRAWNSFEVEDYGFGMFTTNIWMKFREGSSEVCDHRLMSAAIKDQKAVHADMGYWIESSKNQTWQIERASLIEVKTCLWPKTHTLWSNGVLESQMLIPKSYAGPFSQHNYRQGYATQTVGPWHLGKLEIDFGECPGTTVTIQENCDHRGPSLRTTTASGKLVTQWCCRSCTMPPLRFLGEDGCWYGMEIRPLSEKEENMVKSQVTAGQGTSETFSMGLLCLTLFVEECLRRRVTRKHMILAVVITLCAIILGGLTWMDLLRALIMLGDTMSGRIGGQTHLAIMAVFKMSPGYVLGVFLRKLTSRETALMVIGMAMTTTLSIPHDLMELIDGISLGLILLKIVTQFDNTQVGTLALSLTFIRSTMSLVMAWRTIMAVLFVVTLIPLCRTSCLQKQSHWVEITALILGAQALPVYLMTLMKGASRRSWPLNEGIMAVGLVSLLGSALLKNDVPLAGPMVAGGLLLAAYVMSGSSADLSLEKAANVQWDEMADITGSSPIIEVKQDEDGSFSIRDVEETNMITLLVKLALITVSGLYPLAIPITMTLWYMWQVKTQRSGALWDVPSPAATQKAALSEGVYRIMQRGLFGKTQVGVGIHMEGVFHTMWHVTRGSVICHETGRLEPSWADVRNDMISYGGGWRLGDKWDKEEDVQVLAIEPGKNPKHVQTKPGLFKTLTGEIGAVTLDFKPGTSGSPIINRKGKVIGLYGNGVVTKSGDYVSAITQAERIGEPDYEVDEDIFRKKRLTIMDLHPGAGKTKRILPSIVREALKRRLRTLILAPTRVVAAEMEEALRGLPIRYQTPAVKSEHTGREIVDLMCHATFTTRLLSSTRVPNYNLIVMDEAHFTDPSSVAARGYISTRVEMGEAAAIFMTATPPGATDPFPQSNSPIEDIEREIPERSWNTGFDWITDYQGKTVWFVPSIKAGNDIANCLRKSGKKVIQLSRKTFDTEYPKTKLTDWDFVVTTDISEMGANFRAGRVIDPRRCLKPVILTDGPERVILAGPIPVTPASAAQRRGRIGRNLAQEDDQYVFSGDPLKNDEDHAHWTEAKMLLDNIYTPEGIIPTLFGPEREKTQAIDGEFRLRGEQRKTFVELMRRGDLPVWLSYKVASAGISYKDREWCFTGERNNQILEENMEVEIWTREGEKKKLRPKWLDARVYADPMALKDFKEFASGRKSITLDILTEIASLPTYLSSRAKLALDNIVMLHTTERGGRAYQHALNELPESLETLMLVALLGAMTAGIFLFFMQGKGIGKLSMGLITIAVASGLLWVAEIQPQWIAASIILEFFLMVLLIPEPEKQRTPQDNQLIYVILTILTIIGLIAANEMGLIEKTKTDFGFYQVKTETTILDVDLRPASAWTLYAVATTILTPMLRHTIENTSANLSLAAIANQAAVLMGLGKGWPLHRMDLGVPLLAMGCYSQVNPTTLTASLVMLLVHYAIIGPGLQAKATREAQKRTAAGIMKNPTVDGITVIDLEPISYDPKFEKQLGQVMLLVLCAGQLLLMRTTWAFCEVLTLATGPILTLWEGNPGRFWNTTIAVSTANIFRGSYLAGAGLAFSLIKNAQTPRRGTGTTGETLGEKWKRQLNSLDRKEFEEYKRSGILEVDRTEAKSALKDGSKIKHAVSRGSSKIRWIVERGMVKPKGKVVDLGCGRGGWSYYMATLKNVTEVKGYTKGGPGHEEPIPMATYGWNLVKLHSGVDVFYKPTEQVDTLLCDIGESSSNPTIEEGRTLRVLKMVEPWLSSKPEFCIKVLNPYMPTVIEELEKLQRKHGGNLVRCPLSRNSTHEMYWVSGASGNIVSSVNTTSKMLLNRFTTRHRKPTYEKDVDLGAGTRSVSTETEKPDMTIIGRRLQRLQEEHKETWHYDQENPYRTWAYHGSYEAPSTGSASSMVNGVVKLLTKPWDVIPMVTQLAMTDTTPFGQQRVFKEKVDTRTPQPKPGTRMVMTTTANWLWALLGKKKNPRLCTREEFISKVRSNAAIGAVFQEEQGWTSASEAVNDSRFWELVDKERALHQEGKCESCVYNMMGKREKKLGEFGRAKGSRAIWYMWLGARFLEFEALGFLNEDHWFGRENSWSGVEGEGLHRLGYILEEIDKKDGDLMYADDTAGWDTRITEDDLQNEELITEQMAPHHKILAKAIFKLTYQNKVVKVLRPTPRGAVMDIISRKDQRGSGQVGTYGLNTFTNMEVQLIRQMEAEGVITQDDMQNPKGLKERVEKWLRECGVDRLKRMAISGDDCVVKPLDERFGTSLLFLNDMGKVRKDIPQWEPSKGWKNWQEVPFCSHHFHKIFMKDGRSLVVPCRNQDELIGRARISQGAGWSLRETACLGKAYAQMWSLMYFHRRDLRLASMAICSAVPTEWFPTSRTTWSIHAHHQWMTTEDMLKVWNRVWIEDNPNMIDKTPVHSWEDIPYLGKREDLWCGSLIGLSSRATWAKNIHTAITQVRNLIGKEEYADYMPVMKRYSAPSESEGVL

SEQ ID NO: 5205 - protein, 3288 aa, Artificial Sequence
  derived and/or modified protein sequence (wt) from DENV-4__FJ882584__SS-prME
STITLLCLIPTVMAFHLSTRDGEPLMIVAKHERGRPLLFKTTEGINKCTLIAMDLGEMCEDTVTYKCPLLVNTEPEDIDCWCNLTSTWVMYGTCTQSGERRREKRSVALTPHSGMGLETRAETWMSSEGAWKHAQRVESWILRNPGFALLAGFMAYMIGQTGIQRTVFFVLMMLVAPSYGMRCVGVGNRDFVEGVSGGAWVDLVLEHGGCVTTMAQGKPTLDFELTKTTAKEVALLRTYCIEASISNITTATRCPTQGEPYLKEEQDQQYICRRDVVDRGWGNGCGLFGKGGVVTCAKFSCSGKITGNLVQIENLEYTVVVTVHNGDTHAVGNDTSNHGVTATITPRSPSVEVKLPDYGELTLDCEPRSGIDFNEMILMKMKKKTWLVHKQWFLDLPLPWTTGADTSEVHWNYKERMVTFKVPHAKRQDVTVLGSQEGAMHSALAGATEVDSGDGNHMFAGHLKCKVRMEKLRIKGMSYTMCSGKFSIDKEMAETQHGTTVVKVKYEGAGAPCKVPIEIRDVNKEKVVGRVISATPLAENTNSVTNIELEPPFGDSYIVIGVGNSALTLHWFRKGSSIGKMFESTYRGAKRMAILGETAWDFGSVGGLFTSLGKAVHQVFGSVYTTMFGGVSWMIRILIGFLVLWIGTNSRNTSMAMTCIAVGGITLFLGFTVQADMGCVVSWSGRELKCGSGIFVVDNVHTWTEQYKFQPESPARLASAILNAHKDGVCGIRSTTRLENVMWKQITNELNYVLWEGGHDLTVVAGDVKGVLTKGKRALTPPASDLKYSWKTWGKAKIFTPEARNSTFLIDGPDTSECPNERRAWNSFEVEDYGFGMFTTNIWMKFREGSSEVCDHRLMSAAIKDQKAVHADMGYWIESSKNQTWQIERASLIEVKTCLWPKTHTLWSNGVLESQMLIPKSYAGPFSQHNYRQGYATQTVGPWHLGKLEIDFGECPGTTVTIQENCDHRGPSLRTTTASGKLVTQWCCRSCTMPPLRFLGEDGCWYGMEIRPLSEKEENMVKSQVTAGQGTSETFSMGLLCLTLFVEECLRRRVTRKHMILAVVITLCAIILGGLTWMDLLRALIMLGDTMSGRIGGQTHLAIMAVFKMSPGYVLGVFLRKLTSRETALMVIGMAMTTTLSIPHDLMELIDGISLGLILLKIVTQFDNTQVGTLALSLTFIRSTMSLVMAWRTIMAVLFVVTLIPLCRTSCLQKQSHWVEITALILGAQALPVYLMTLMKGASRRSWPLNEGIMAVGLVSLLGSALLKNDVPLAGPMVAGGLLLAAYVMSGSSADLSLEKAANVQWDEMADITGSSPIIEVKQDEDGSFSIRDVEETNMITLLVKLALITVSGLYPLAIPITMTLWYMWQVKTQRSGALWDVPSPAATQKAALSEGVYRIMQRGLFGKTQVGVGIHMEGVFHTMWHVTRGSVICHETGRLEPSWADVRNDMISYGGGWRLGDKWDKEEDVQVLAIEPGKNPKHVQTKPGLFKTLTGEIGAVTLDFKPGTSGSPIINRKGKVIGLYGNGVVTKSGDYVSAITQAERIGEPDYEVDEDIFRKKRLTIMDLHPGAGKTKRILPSIVREALKRRLRTLILAPTRVVAAEMEEALRGLPIRYQTPAVKSEHTGREIVDLMCHATFTTRLLSSTRVPNYNLIVMDEAHFTDPSSVAARGYISTRVEMGEAAAIFMTATPPGATDPFPQSNSPIEDIEREIPERSWNTGFDWITDYQGKTVWFVPSIKAGNDIANCLRKSGKKVIQLSRKTFDTEYPKTKLTDWDFVVTTDISEMGANFRAGRVIDPRRCLKPVILTDGPERVILAGPIPVTPASAAQRRGRIGRNPAQEDDQYVFSGDPLKNDEDHAHWTEAKMLLDNIYTPEGIIPTLFGPEREKTQAIDGEFRLRGEQRKTFVELMRRGDLPVWLSYKVASAGISYKDREWCFTGERNNQILEENMEVEIWTREGEKKKLRPKWLDARVYADPMALKDFKEFASGRKSITLDILTEIASLPTYLSSRAKLALDNIVMLHTTERGGRAYQHALNELPESLETLMLVALLGAMTAGIFLFFMQGKGIGKLSMGLITIAVASGLLWVAEIQPQWIAASIILEFFLMVLLIPEPEKQRTPQDNQLIYVILTILTIIGLIAANEMGLIEKTKTDFGFYQVKTETTILDVDLRPASAWTLYAVATTILTPMLRHTIENTSANLSLAAIANQAAVLMGLGKGWPLHRMDLGVPLLAMGCYSQVNPTTLTASLVMLLVHYAIIGPGLQAKATREAQKRTAAGIMKNPTVDGITVIDLEPISYDPKFEKQLGQVMLLVLCAGQLLLMRTTWAFCEVLTLATGPILTLWEGNPGRFWNTTIAVSTANIFRGSYLAGAGLAFSLIKNAQTPRRGTGTTGETLGEKWKRQLNSLDRKEFEEYKRSGILEVDRTEAKSALKDGSKIKHAVSRGSSKIRWIVERGMVKPKGKVVDLGCGRGGWSYYMATLKNVTEVKGYTKGGPGHEEPIPMATYGWNLVKLHSGVDVFYKPTEQVDTLLCDIGESSSNPTIEEGRTLRVLKMVEPWLSSKPEFCIKVLNPYMPTVIEELEKLQRKHGGNLVRCPLSRNSTHEMYWVSGASGNIVSSVNTTSKMLLNRFTTRHRKPTYEKDVDLGAGTRSVSTETEKPDMTIIGRRLQRLQEEHKETWHYDQENPYRTWAYHGSYEAPSTGSASSMVNGVVKLLTKPWDVIPMVTQLAMTDTTPFGQQRVFKEKVDTRTPQPKPGTRMVMTTTANWLWALLGKKKNPRLCTREEFISKVRSNAAIGAVFQEEQGWTSASEAVNDSRFWELVDKERALHQEGKCESCVYNMMGKREKKLGEFGRAKGSRAIWYMWLGARFLEFEALGFLNEDHWFGRENSWSGVEGEGLHRLGYILEEIDKKDGDLMYADDTAGWDTRITEDDLQNEELITEQMAPHHKILAKAIFKLTYQNKVVKVLRPTPRGAVMDIISRKDQRGSGQVGTYGLNTFTNMEVQLIRQMEAEGVITQDDMQNPKGLKERVEKWLRECGVDRLKRMAISGDDCVVKPLDERFGTSLLFLNDMGKVRKDIPQWEPSKGWKNWQEVPFCSHHFHKIFMKDGRSLVVPCRNQDELIGRARISQGAGWSLRETACLGKAYAQMWSLMYFHRRDLRLASMAICSAVPTEWFPTSRTTWSIHAHHQWMTTEDMLKVWNRVWIEDNPNMIDKTPVHSWEDIPYLGKREDLWCGSLIGLSSRATWAKNIHTAITQVRNLIGKEEYVDYMPVMKRYSAPSESEGVL

SEQ ID NO: 5206 - protein, 3288 aa, Artificial Sequence
  derived and/or modified protein sequence (wt) from DENV-4__FJ882585__SS-prME
STITLLCLIPTVMAFHLSTRDGEPLMIVAKHERGRPLLFKTTEGINKCTLIAMDLGEMCEDTVTYKCPLLVNTEPEDIDCWCNLTSTWVMYGTCTQSGERRREKRSVALTPHSGMGLETRAETWMSSEGAWKHAQRVESWILRNPGFALLAGFMAYMIGQTGIQRTVFFVLMMLVAPSYGMRCVGVGNRDFVEGVSGGAWVDLVLEHGGCVTTMAQGKPTLDFELTKTTAKEVALLRTYCIEALISNITTATRCPTQGEPYLKEEQDQQYICRRDVVDRGWGNGCGLFGKGGVVTCAKFSCSGKITGNLVQIENLEYTVVVTVHNGDTHAVGNDTSNHGVTATITPRSPSVEVKLPDYGELTLDCEPRSGIDFNEMILMKMKKKTWLVHKQWFLDLPLPWTTGADTSEVHWNYKERMVTFKVPHAKRQDVTVLGSQEGAMHSALAGATEVDSGDGNHMFAGHLKCKVRMEKLRIKGMSYTMCSGKFSIDKEMAETQHGTTVVKVKYEGAGAPCKVPIEIRDVNKEKVVGRVISATPLAENTNSVTNIELEPPFGDSYIVIGVGNSALTLHWFRKGSSIGKMFESTYRGAKRMAILGETAWDFGSVGGLFTSLGKAVHQVFGSVYTTMFGGVSWMIRILIGFLVLWIGTNSRNTSMAMTCIAVGGITLFLGFTVQADMGCVVSWSGRELKCGSGIFVVDNVHTWTEQYKFQPESPARLASAILNAHKDGVCGIRSTTRLENVMWKQITNELNYVLWEGGHDLTVVAGDVKGVLTKGKRALTPPASDLKYSWKTWGKAKIFTPEARNSTFLIDGPDTSECPNERRAWNSFEVEDYGFGMFTTNIWMKFREGSSEVCDHRLMSAAIKDQKAVHADMGYWIESSKNQTWQIERASLIEVKTCLWPKTHTLWSNGVLESQMLIPKSYAGPFSQHNYRQGYATQTVGPWHLGKLEIDFGECPGTTVTIQENCDHRGPSLRTTTASGKLVTQWCCRSCTMPPLRFLGEDGCWYGMEIRPLSEKEENMVKSQVTAGQGTSETFSMGLLCLTLFVEECLRRRVTRKHMILAVVITLCATILGGLTWMDLLRALIMLGDTMSGRIGGQTHLAIMAVFKMSPGYVLGVFLRKLTSRETALMVIGMAMTTTLSIPHDLMELIDGISLGLILLKIVTQFDNTQVGTLALSLTFIRSTMSLVMAWRTIMAVLFVVTLIPLCRTSCLQKQSHWVEITALILGAQALPVYLMTLMKGASRRSWPLNEGIMAVGLVSLLGSALLKNDVPLAGPMVAGGLLLAAYVMSGSSADLSLEKAANVQWDEMAAITGSSPIIEVKQDEDGSFSIRDVEETNMITLLVKLALITVSGLYPLAIPITMTLWYMWQVKTQRSGALWDVPSPAATQKAALSEGVYRIMQRGLFGKTQVGVGIHMEGVFHTMWHVTRGSVICHETGRLEPSWADVRNDMISYGGGWRLGDKWDKEEDVQVLAIEPGKNPKHVQTKPGLFKTLTGEIGAVTLDFKPGTSGSPIINRKGKVIGLYGNGVVTKSGDYVSAITQAERIGEPDYEVDEDIFRKKRLTIMDLHPGAGKTKRILPSIVREALKRRLRTLILAPTRVVAAEMEEALRGLPIRYQTPAVKSEHTGREIVDLMCHATFTTRLLSSTRVPNYNLIVMDEAHFTDPSSVAARGYISTRVEMGEAAAIFMTATPPGATDPFPQSNSPIEDIEREIPERSWNTGFDWITDYQGKTVWFVPSIKAGNDIANCLRKSGKKVIQLSRKTFDTEYPKTKLTDWDFVVTTDISEMGANFRAGRVIDPRRCLKPVILTDGPERVILAGPIPVTPASAAQRRGRIGRNPAQEDDQYVFSGDPLKNDEDHAHWTEAKMLLDNIYTPEGIIPTLFGPEREKTQAIDGEFRLRGEQRKTFVELMRRGDLPVWLSYKVASAGISYKDREWCFTGERNNQILEENMEVEIWTREGEKKKLRPKWLDARVYADPMALKDFKEFASGRKSTTLDILTEIASLPTYLSSRAKLALDNIVMLHTTERGGRAYQHALNELPESLETLMLVALLGAMTAGIFLFFMQGKGIGKLSMGLITIAVASGLLWVAEIQPQWIAASIILEFFLMVLLIPEPEKQRTPQDNQLIYVILTILTIIGLIAANEMGLIEKTKTDFGFYQVKTETTILDVDLRPASAWTLYAVATTILTPMLRHTIENTSANLSLAAIANQAAVLMGLGKGWPLHRMDLGVPLLAMGCYSQVNPTTLTASLVMLLVHYAIIGPGLQAKATREAQKRTAAGIMKNPTVDGITVIDLEPISYDPKFEKQLGQVMLLVLCAGQLLLMRTTWAFCEVLTLATGPILTLWEGNPGRFWNTTIAVSTANIFRGSYLAGAGLAFSLIKNAQTPRRGTGTTGETLGEKWKRQLNSLDRKEFEEYKRSGILEVDRTEAKSALKDGSKIKHAVSRGSSKIRWIVERGMVKPKGKVVDLGCGRGGWSYYMATLKNVTEVKGYTKGGPGHEEPIPMATYGWNLVKLHSGVDVFYKPTEQVDTLLCDIGESSSNPTIEEGRTLRVLKMVEPWLSSKPEFCIKVLNPYMPTVIEELEKLQRKHGGNLVRCPLSRNSTHEMYWVSGASGNIVSSVNTTSKMLLNRFTTRHRKPTYEKDVDLGAGTRSVSTETEKPDMTIIGRRLQRLQEEHKETWHYDQENPYRTWAYHGSYEAPSTGSASSMVNGVVKLLTKPWDVIPMVTQLAMTDTTPFGQQRVFKEKVDTRTPQPKPGTRMVMTTTANWLWALLGKKKNPRLCTKEEFISKVRSNAAIGAVFQEEQGWTSASEAVNDSRFWELVDKERALHQEGKCESCVYNMMGKREKKLGEFGRAKGSRAIWYMWLGARFLEFEALGFLNEDHWFGRENSWSGVEGEGLHRLGYILEEIDKKDGDLMYADDTAGWDTRITEDDLQNEELITEQMAPHHKILAKAIFKLTYQNKVVKVLRPTPRGAVMDIISRKDQRGSGQVGTYGLNTFTNMEVQLIRQMEAEGVITQDDMQNPKGLKERVEKWLRECGVDRLKRMAISGDDCVVKPLDERFGTSLLFLNDMGKVRKDIPQWEPSKGWKNWQEVPFCSHHFHKIFMKDGRSLVVPCRNQDELIGRARISQGAGWSLRETACLGKAYAQMWSLMYFHRRDLRLASMAICSAVPTEWFPTSRTTWSIHAHHQWMTTEDMLKVWNRVWIEDNPNMTDKTPVHSWEDIPYLGKREDLWCGSLIGLSSRATWAKNIHTAITQVRNLIGKEEYVDYMPVMKRYSAPSESEGVL

SEQ ID NO: 5207 - protein, 3288 aa, Artificial Sequence
  derived and/or modified protein sequence (wt) from DENV-4__FJ882586__SS-prME
STITLLCLIPTVMAFHLSTRDGEPLMIVAKHERGRPLLFKTTEGINKCTLIAMDLGEMCEDTVTYKCPLLVNTEPEDIDCWCNLTSTWVMYGTCTQSGERRREKRSVALTPHSGMGLETRAETWMSSEGAWKHAQRVESWILRNPGFALLAGFMAYMIGQTGIQRTVFFVLMMLVAPSYGMRCVGVGNRDFVEGVSGGAWVDLVLEHGGCVTTMAQGKPTLDFELTKTTAKEVALLRTYCIEALISNITTATRCPTQGEPYLKEEQDQQYICRRDVVDRGWGNGCGLFGKGGVVTCAKFSCSGKITGNLVQIENLEYTVVVTVHNGDTHAVGNDTSNHGVTATITPRSPSVEVKLPDYGELTLDCEPRSGIDFNEMILMKMKKKTWLVHKQWFLDLPLPWTTGADTSEVHWNYKERMVTFKVPHAKRQDVTVLGSQEGAMHSALAGATEVDSGDGNHMFAGHLKCKVRMEKLRIKGMSYTMCSGKFSIDKEMAETQHGTTVVKVKYEGAGAPCKVPIEIRDVNKEKVVGRVISATPLAENTNSVTNIELEPPFGDSYIVIGVGNSALTLHWFRKGSSIGKMFESTYRGAKRMAILGETAWDFGSVGGLFTSLGKAVHQVFGSVYTTMFGGVSWMIRILIGFLVLWIGTNSRNTSMAMTCIAVGGITLFLGFTVQADMGCVVSWSGRELKCGSGIFVVDNVHTWTEQYKFQPESPARLASAILNAHKDGVCGIRSTTRLENVMWKQITNELNYVLWEGGHDLTVVAGDVKGVLTKGKRALTPPASDLKYSWKTWGKAKIFTPEARNSTFLIDGPDTSECPNERRAWNSFEVEDYGFGMFTTNIWMKFREGSSEVCDHRLMSAAIKDQKAVHADMGYWIESSKNQTWQIERASLIEVKTCLWPKTHTLWSNGVLESQMLIPKSYAGPFSQHNYRQGYATQTVGPWHLGKLEIDFGECPGTTVTIQENCDHRGPSLRTTTASGKLVTQWCCRSCTMPPLRFLGEDGCWYGMEIRPLSEKEENMVKSQVTAGQGTSETFSMGLLCLTLFVEECLRRRVTRKHMILAVVITLCAIILGGLTWMDLLRALIMLGDTMSGRIGGQTHLAIMAVFKMSPGYVLGVFLRKLTSRETALMVIGMAMTTTLSIPHDLMELIDGISLGLILLKIVTQFDNTQVGTLALSLTFIRSTMSLVMAWRTIMAVLFVVTLIPLCRTSCLQKQSHWVEITALILGAQALPVYLMTLMKGASRRSWPLNEGIMAVGLVSLLGSALLKNDVPLAGPMVAGGLLLAAYVMSGSSADLSLEKAANVQWDEMADITGSSPIIEVKQDEDGSFSIRDVEETNMITLLVKLALITVSGLYPLAIPITMTLWYMWQVKTQRSGALWDVPSPAATQKAALSEGVYRIMQRGLFGKTQVGVGIHMEGVFHTMWHVTRGSVICHETGRLEPSWADVRNDMISYGGGWRLGDKWDKEEDVQVLAIEPGKNPKHVQTKPGLFKTLTGEIGAVTLDFKPGTSGSPIINRKGKVIGLYGNGVVTKSGDYVSAITQAERIGEPDYEVDEDIFRKKRLTIMDLHPGAGKTKRILPSIVREALKRRLRTLILAPTRVVAAEMEEALRGLPIRYQTPAVKSEHTGREIVDLMCHATFTTRLLSSTRVPNYNLIVMDEAHFTDPSSVAARGYISTRVEMGEAAAIFMTATPPGATDPFPQSNSPIEDIEREIPERSWNTGFDWITDYQGKTVWFVPSIKAGNDIANCLRKSGKKVIQLSRKTFDTEYPKTKLTDWDFVVTTDISEMGANFRAGRVIDPRRCLKPVILTDGPERVILAGPIPVTPASAAQRRGRIGRNPAQEDDQYVFSGDPLKNDEDHAHWTEAKMLLDNIYTPEGIIPTLFGPEREKTQAIDGEFRLRGEQRKTFVELMRRGDLPVWLSYKVASAGISYKDREWCFTGERNNQILEENMEVEIWTREGEKKKLRPKWLDARVYADPMALKDFKEFASGRKSITLDILTEIASLPTYLSSRAKLALDNIVMLHTTERGGRAYQHALNELPESLETLMLVALLGAMTAGIFLFFMQGKGIGKLSMGLITIAVASGLLWVAEIQPQWIAASIILEFFLMVLLIPEPEKQRTPQDNQLIYVILTILTIIGLIAANEMGLIEKTKTDFGFYQVKTETTILDVDLRPASAWTLYAVATTILTPMLRHTIENTSANLSLAAIANQAAVLMGLGKGWPLHRMDLGVPLLAMGCYSQVNPTTLTASLVMLLVHYAIIGPGLQAKATREAQKRTAAGIMKNPTVDGITVIDLEPISYDPKFEKQLGQVMLLVLCAGQLLLMRTTWAFCEVLTLATGPILTLWEGNPGRFWNTTIAVSTANIFRGSYLAGAGLAFSLIKNAQTPRRGTGTTGETLGEKWKRQLNSLDRKEFEEYKRSGILEVDRTEAKSALKDGSKIKHAVSRGSSKIRWIVERGMVKPKGKVVDLGCGRGGWSYYMATLKNVTEVKGYTKGGPGHEEPIPMATYGWNLVKLHSGVDVFYKPTEQVDTLLCDIGESSSNPTIEEGRTLRVLKMVEPWLSSKPEFCIKVLNPYMPTVIEELEKLQRKHGGNLVRCPLSRNSTHEMYWVSGASGNIVSSVNTTSKMLLNRFTTRHRKPTYEKDVDLGAGTRSVSTETEKPDMTIIGRRLQRLQEEHKETWHYDQENPYRTWAYHGSYEAPSTGSASSMVNGVVKLLTKPWDVIPMVTQLAMTDTTPFGQQRVFKEKVDTRTPQPKPGTRMVMTTTANWLWALLGKKKNPRLCTREEFISKVRSNAAIGAVFQEEQGWTSASEAVNDSRFWELVDKERALHQEGKCESCVYNMMGKREKKLGEFGRAKGSRAIWYMWLGARFLEFEALGFLNEDHWFGRENSWSGVEGEGLHRLGYILEEIDKKDGDLMYADDTAGWDTRITEDDLQNEELITEQMAPHHKILAKAIFKLTYQNKVVKVLRPTPRGAVMDIISRKDQRGSGQVGTYGLNTFTNMEVQLIRQMEAEGVITQDDMQNPKGLKERVEKWLRECGVDRLKRMAISGDDCVVKPLDERFGTSLLFLNDMGKVRKDIPQWEPSKGWKNWQEVPFCSHHFHKIFMKDGRSLVVPCRNQDELIGRARISQGAGWSLRETACLGKAYAQMWSLMYFHRRDLRLASMAICSAVPTEWFPTSRTTWSIHAHHQWMTTEDMLKVWNRVWIEDNPNMIDKTPVHSWEDIPYLGKREDLWCGSLIGLSSRATWAKNIHTAIAQVRNLIGKEEYVDYMPVMKRYSAPSESEGVL

SEQ ID NO: 5208 - protein, 3288 aa, Artificial Sequence
  derived and/or modified protein sequence (wt) from DENV-4__JN819406__SS-prME
STITLLCLIPTVMAFHLSTRDGEPLMIVAKHERGRPLLFKTTEGINKCTLIAMDLGEMCEDTVTYKCPLLVNTEPEDIDCWCNLTSTWVMYGTCTQSGERRREKRSVALTPHSGMGLETRAETWMSSEGAWKHAQRVESWILRNPGFALLAGFMAYMIGQTGIQRTVFFVLMMLVAPSYGMRCVGVGNRDFVEGVSGGAWVDLVLEHGGCVTTMAQGKPTLDFELTKTTAKEVALLRTYCIEALISNITTATRCPTQGEPYLKEEQDQQYICRRDVVDRGWGNGCGLFGKGGVVTCAKFSCSGKITGNLVQIENLEYTVVVTVHNGDTHAVGNDTSNHGVTATITPRSPSVEVKLPDYGELTLDCEPRSGIDFNEMILMKMKKKTWLVHKQWFLDLPLPWTTGADTSEVHWNYKERMVTFKVPHAKRQDVTVLGSQEGAMHSALAGATEVDSGDGNHMFAGHLKCKVRMEKLRIKGMSYTMCSGKFSIDKEMAETQHGTTVVKVKYEGAGAPCKVPIEIRDVNKEKVVGRVISATPLAENTNSVTNIELEPPFGDSYIVIGVGNSALTLHWFRKGSSIGKMFESTYRGAKRMAILGETAWDFGSVGGLFTSLGKAVHQVFGSVYTTMFGGVSWMIRILIGFLVLWIGTNSRNTSMAMTCIAVGGITLFLGFTVQADMGCVVSWSARELKCGSGIFVVDNVHTWTEQYQFQPESPARLASAILNAHKDGVCGIRSTTRLENVMWKQITNELNYVLWEGGHDLTVVAGDVKGVLTKGKRALTPPASDLKYSWKTWGKAKIFTPEARNSTFLIDGPDTSECPNERRAWNSFEVEDYGFGMFTTNIWMKFREGSSEVCDHRLMSAAIKDQKAVHADMGYWIESSKNQTWQIERASLIEVKTCLWPKTHTLWSNGVLESQMLIPKSYAGPFSQHNYRQGYATQTVGPWHLGKLEIDFGECPGTTVTIQENCDHRGPSLRTTTASGKLVTQWCCRSCTMPPLRFLGEDGCWYGMEIRPLSEKEENMVKSQVTAGQGTSETFSMGLLCLTLFVEECLRRRVTRKHMILAVVITLCAIILGGLTWMDLLRALIMLGDTMSGRIGGQTHLAIMAVFKMSPGYVLGVFLRKLTSRETALMVIGMAMTTTLSIPHDLMELIDGISLGLILLKIVTQFDNTQVGTLALSLTFIRSTMSLVMAWRTIMAVLFVVTLIPLCRTSCLQKQSHWVEITALILGAQALPVYLMTLMKGASRRSWPLNEGIMAVGLVSLLGSALLKNDVPLAGPMVAGGLLLAAYVMSGSSADLSLEKAANVQWDEMADITGSSPIIEVKQDEDGSFSIRDVEETNMITLLVKLALITVSGLYPLAIPITMTLWYMWQVKTQRSGALWDVPSPAATQKAALSEGVYRIMQRGLFGKTQVGVGIHMEGVFHTMWHVTRGSVICHETGRLEPSWADVRNDMISYGGGWRLGDKWDKEEDVQVLAIEPGKNPKHVQTKPGLFKTLTGEIGAVTLDFKPGTSGSPIINRKGKVIGLYGNGVVTKSGDYVSAITQAERIGEPDYEVDEDIFRKKRLTIMDLHPGAGKTKRILPSIVREALKRRLRTLILAPTRVVAAEMEEALRGLPIRYQTPAVKSEHTGREIVDLMCHATFTTRLLSSTRVPNYNLIVMDEAHFTDPSSVAARGYISTRVEMGEAAAIFMTATPPGATDPFPQSNSPIEDIEREIPERSWNTGFDWITDYQGKTVWFVPSIKAGNDIANCLRKSGKKVIQLSRKTFDTEYPKTKLTDWDFVVTTDISEMGANFRAGRVIDPRRCLKPVILTDGPERVILAGPIPVTPASAAQRRGRIGRNPAQEDDQYVFSGDPLKNDEDHAHWTEAKMLLDNIYTPEGIIPTLFGPEREKTQAIDGEFRLRGEQRKTFVELMRRGDLPVWLSYKVASAGISYKDREWCFTGERNNQILEENMEVEIWTREGEKKKLRPKWLDARVYADPMALKDFKEFASGRKSITLDILTEIASLPTYLSSRAKLALDNIVMLHTTERGGRAYQHALNELPESLETLMLVALLGAMTAGIFLFFMQGKGIGKLSMGLITIAVASGLLWVAEIQPQWIAASIILEFFLMVLLIPEPEKQRTPQDNQLIYVILTILTIIGLIAANEMGLIEKTKTDFGFYQVKTETTILDVDLRPASAWTLYAVATTILTPMLRHTIENTSANLSLAAIANQAAVLMGLGKGWPLHRMDLGVPLLAMGCYSQVNPTTLTASLVMLLVHYAIIGPGLQAKATREAQKRTAAGIMKNPTVDGITVIDLEPISYDPKFEKQLGQVMLLVLCAGQLLLMRTTWAFCEVLTLATGPILTLWEGNPGRFWNTTIAVSTANIFRGSYLAGAGLAFSLIKNAQTPRRGTGTTGETLGEKWKRQLNSLDRKEFEEYKRSGILEVDRTEAKSALKDGSKIKHAVSRGSSKIRWIVERGMVKPKGKVVDLGCGRGGWSYYMATLKNVTEVKGYTKGGPGHEEPIPMATYGWNLVKLHSGVDVFYKPTEQVDTLLCDIGESSSNPTIEEGRTLRVLKMVEPWLSSKPEFCIKVLNPYMPTVIEELEKLQRKHGGNLVRCPLSRNSTHEMYWVSGASGNIVSSVNTTSKMLLNRFTTRHRKPTYEKDVDLGAGTRSVSTETEKPDMTIIGRRLQRLQEEHKETWHYDQENPYRTWAYHGSYEAPSTGSASSMVNGVVKLLTKPWDVIPMVTQLAMTDTTPFGQQRVFKEKVDTRTPQPKPGTRMVMTTTANWLWALLGKKKNPRLCTREEFISKVRSNAAIGAVFQEEQGWTSASEAVNDSRFWELVDKERALHQEGKCESCVYNMMGKREKKLGEFGRAKGSRAIWYMWLGARFLEFEALGFLNEDHWFGRENSWSGVEGEGLHRLGYILEEIDKKDGDLMYADDTAGWDTRITEDDLQNEELITEQMAPHHKILAKAIFKLTYQNKVVKVLRPTPRGAVMDIISRKDQRGSGQVGTYGLNTFTNMEVQLIRQMEAEGVITQDDMQNPKGLKERVEKWLRECGVDRLKRMAISGDDCVVKPLDERFGTSLLFLNDMGKVRKDIPQWEPSKGWKNWQEVPFCSHHFHKIFMKDGRSLVVPCRNQDELIGRARISQGAGWSLRETACLGKAYAQMWSLMYFHRRDLRLASMAICSAVPTEWFPTSRTTWSIHAHHQWMTTEDMLKVWNRVWIEDNPNMIDKTPVHSWEDIPYLGKREDLWCGSLIGLSSRATWAKNIHTAITQVRNLIGKEEYVDYMPVMKRYSAPSESEGVL

SEQ ID NO: 5209 - protein, 3288 aa, Artificial Sequence
  derived and/or modified protein sequence (wt) from DENV-4__GQ199876__SS-prME
STITLLCLIPTVMAFHLSTRDGEPLMIVAKHERGRPLLFKTTEGINKCTLIAMDLGEMCEDTVTYKCPLLVNTEPEDIDCWCNLTSTWVMYGTCTQSGERRREKRSVALTPHSGMGLETRAETWMSSEGAWKHAQRVESWILRNPGFALLAGFMAYMIGQTGIQRTVFFVLMMLVAPSYGMRCVGVGNRDFVEGVSGGAWVDLVLEHGGCVTTMAQGKPTLDFELTKTTAKEVALLRTYCIEALISNITTATRCPTQGEPYLKEEQDQQYICRRDVVDRGWGNGCGLFGKGGVVTCAKFSCSGKITGNLVQIENLEYTVVVTVHNGDTHAVGNDTSNHGVTATITPRSPSVEVKLPDYGELTLDCEPRSGIDFNEMILMKMKKKTWLVHKQWFLDLPLPWTTGADTSEVHWNYKERMVTFKVPHAKRQDVTVLGSQEGAMHSALAGATEVDSGDGNHMFAGHLKCKVRMEKLRIKGMSYTMCSGKFSIDKEMAETQHGTTVVKVKYEGAGAPCKVPIEIRDVNKEKVIGRVISATPLAENTNSVTNIELEPPFGDSYIVIGVGNSALTLHWFRKGSSIGKMFESTYRGAKRMAILGETAWDFGSVGGLFTSLGKAVHQVFGSVYTTMFGGVSWMIRILIGFLVLWIGTNSRNTSMAMTCIAVGGITLFLGFTVQADMGCVVSWSGRELKCGSGIFVVDNVHTWTEQYKFQPESPARLASAILNAHKDGVCGIRSTTRLENVMWKQITNELNYVLWEGGHDLTVVAGDVKGVLTKGKRALTPPASDLKYSWKTWGKAKIFTPEARNSTFLIDGPDTSECPNERRAWNSFEVEDYGFGMFTTNIWMKFREGSSEVCDHRLMSAAIKDQKAVHADMGYWIESSKNQTWQIERASLIEVKTCLWPKTHTLWSNGVLESQMLIPKSYAGPFSQHNYRQGYATQTVGPWHLGKLEIDFGECPGTTVTIQENCDHRGPSLRTTTASGKLVTQWCCRSCTMPPLRFLGEDGCWYGMEIRPLSEKEENMVKSQVTAGQGTSETFSMGLLCLTLFVEECLRRRVTRKHMILAVVITLCAIILGGLTWMDLLRALIMLGDTMSGRIGGQTHLAIMAVFKMSPGYVLGVFLRKLTSRETALMVIGMAMTTTLSIPHDLMELIDGISLGLILLKIVTQFDNTQVGTLALSLTFIRSTMSLVMAWRTIMAVLFVVTLIPLCRTSCLQKQSHWVEITALILGAQALPVYLMTLMKGASRRSWPLNEGIMAVGLVSLLGSALLKNDVPLAGPMVAGGLLLAAYVMSGSSADLSLEKAANVQWDEMADITGSSPIIEVKQDEDGSFSIRDVEETNMITLLVKLALITVSGLYPLAIPITMTLWYMWQVKTQRSGALWDVPSPAATQKAALSEGVYRIMQRGLFGKTQVGVGIHMEGVFHTMWHVTRGSVICHETGRLEPSWADVRNDMISYGGGWRLGDKWDKEEDVQVLAIEPGKNPKHVQTKPGLFKTLTGEIGAVTLDFKPGTSGSPIINRKGKVIGLYGNGVVTKSGDYVSAITQAERIGEPDYEVDEDIFRKKRLTIMDLHPGAGKTKRILPSIVREALKRRLRTLILAPTRVVAAEMEEALRGLPVRYQTPAVKSEHTGREIVDLMCHATFTTRLLSSTRVPNYNLIVMDEAHFTDPSSVAARGYISTRVEMGEAAAIFMTATPPGATDPFPQSNSPIEDIEREIPERSWNTGFDWITDYQGKTVWFVPSIKAGNDIANCLRKSGKKVIQLSRKTFDTEYPKTKLTDWDFVVTTDISEMGANFRAGRVIDPRRCLKPVILTDGPERVILAGPIPVTPASAAQRRGRIGRNPAQEDDQYVFSGDPLKNDEDHAHWTEAKMLLDNIYTPEGIIPTLFGPEREKTQAIDGEFRLRGEQRKTFVELMRRGDLPVWLSYKVASAGISYKDREWCFTGERNNQILEENMEVEIWTREGEKKKLRPKWLDARVYADPMALKDFKEFASGRKSITLDILTEIASLPTYLSSRAKLALDNIVMLHTTERGGRAYQHALNELPESLETLMLVALLGAMTAGIFLFFMQGKGIGKLSMGLITIAVASGLLWVAEIQPQWIAASIILEFFLMVLLIPEPEKQRTPQDNQLIYVILTILTIIGLIAANEMGLIEKTKTDFGFYQVKTETTILDVDLRPASAWTLYAVATTILTPMLRHTIENTSANLSLAAIANQAAVLMGLGKGWPLHRMDLGVPLLAMGCYSQVNPTTLTASLVMLLVHYAIIGPGLQAKATREAQKRTAAGIMKNPTVDGITVIDLEPISYDPKFEKQLGQVMLLVLCAGQLLLMRTTWAFCEVLTLATGPILTLWEGNPGRFWNTTIAVSTANIFRGSYLAGAGLAFSLIKNAQTPRRGTGTTGETLGEKWKRQLNSLDRKEFEEYKRSGILEVDRTEAKSALKDGSKIKHAVSRGSSKIRWIVERGMVKPKGKVVDLGCGRGGWSYYMATLKNVTEVKGYTKGGPGHEEPIPMATYGWNLVKLHSGVDVFYKPTEQVDTLLCDIGESSSNPTIEEGRTLRVLKMVEPWLSSKPEFCIKVLNPYMPTVIEELEKLQRKHGGNLVRCPLSRNSTHEMYWVSGASGNIVSSVNTTSKMLLNRFTTRHRKPTYEKDVDLGAGTRSVSTETEKPDMTIIGRRLQRLQEEHKETWHYDQENPYRTWAYHGSYEAPSTGSASSMVNGVVKLLTKPWDVIPMVTQLAMTDTTPFGQQRVFKEKVDTRTPQPKPGTRMVMTTTANWLWALLGKKKNPRLCTREEFISKVRSNAAIGAVFQEEQGWTSASEAVNDSRFWELVDKERALHQEGKCESCVYNMMGKREKKLGEFGRAKGSRAIWYMWLGARFLEFEALGFLNEDHWFGRENSWSGVEGEGLHRLGYILEEIDKKDGDLMYADDTAGWDTRITEDDLQNEELITEQMAPHHKILAKAIFKLTYQNKVVKVLRPTPRGAVMDIISRKDQRGSGQVGTYGLNTFTNMEVQLIRQMEAEGVITQDDMQNPKGLKERVEKWLRECGVDRLKRMAISGDDCVVKPLDERFGTSLLFLNDMGKVRKDIPQWEPSKGWKNWQEVPFCSHHFHKIFMKDGRSLVVPCRNQDELIGRARISQGAGWSLRETACLGKAYAQMWSLMYFHRRDLRLASMAICSAVPTEWFPTSRTTWSIHAHHQWMTTEDMLKVWNRVWIEDNPNMTDKTPVHSWEDIPYLGKREDLWCGSLIGLSSRATWAKNIHTAITQVRNLIGKEEYVDYMPVMKRYSAPSESEGVL

SEQ ID NO: 5210 - protein, 3288 aa, Artificial Sequence
  derived and/or modified protein sequence (wt) from DENV-4__KP723482__SS-prME
STMTLLCLIPTVMAFHLSTRDGEPLMIVAKHERGRPLLFKTTEGINKCTLIAMDLGEMCEDTVTYKCPLLVNTEPEDIDCWCNLTSTWVMYGTCTQSGERRREKRSVALTPHSGMGLETRAETWMSSEGAWKHAQRVESWILRNPGFALLAGFMAYMIGQTGIQRTVFFVLMMLVAPSYGMRCVGVGNRDFVEGVSGGAWVDLVLEHGGCVTTMAQGKPTLDFELTKTTAKEVALLRTYCIEASISNITTATRCPTQGEPYLKEEQDQQYICRRDVVDRGWGNGCGLFGKGGVVTCAKFLCSGKITGNLVQIENLEYTVVVTVHNGNTHAVGNDTSNHGVTATITPRSPSVEVKLPDYGELTLDCEPRSGIDFNEMILMKMKKKTWLVHKQWFLDLPLPWTAGADTSEVHWNYKERMVTFKVPHAKRQDVTVLGSQEGAMHSALAGATEVDSGDGNHMFAGHLKCKVRMEKLRIKGMSYTMCSGKFSIDKEMAETQHGTTVVKVKYEGAGAPCKVPIEIRDVNKEKVVGRIISSTPFAENTNSVTNIELEPPFGDSYIVIGVGDSALTLHWFRKGSSIGKMFESTYRGAKRMAILGETAWDFGSVGGLFTSLGKAVHQVFGSVYTTMFGGVSWMIRILIGFLVLWIGTNSRNTSMAMTCIAVGGITLFLGFTVQADMGCVVSWNGKELKCGSGIFVVDNVHTWTEQYKFQPESPARLASAILNAHKDGVCGIRSTTRLENVMWKQITNELNYVLWEGGHDLTVVAGDVKGVLTKGKRALTPPVNDLKYSWKTWGKAKIFTPEARNSTFLIDGPDTSECPNERRAWNFFEVEDYGFGMFTTNIWMKFREGSSEVCDHRLMSAAIKDQKAVHADMGYWIESSKNQTWQIEKASLIEVKTCLWPKTHTLWSNGVLESQMLIPRSYAGPFSQHNYRQGYATQTAGPWHLGKLEIDFGECPGTTVTIQEDCDHRGPSLRTTTASGKLVTQWCCRSCTMPPLRFLGEDGCWYGMEIRPLSEKEENMVKSQVTAGQGTSETFSMGLLCLTLFVEECLRRRVTRKHMILAVVITFCAIILGGLTWMDLLRVLIMLGDTMSGRIGGQIHLAIMAVFKMSPGYVLGVFLRKLTSRETALMVIGMAMTTVFSIPHDLMELIDGISLGLILLKIVTHFDNTQVGTLALSLTFIRSTTPLVMAWRTIMAVFFVVTLIPLCRTSCLQKQSHWVEITALILGAQALPVYLMTLMKGASRRSWPLNEGIMAVGLVSLLGSALLKNDVPLAGPMVAGGLLLAAYVMSGSSADLSLEKAANVQWDEMADITGSSPIIEVKQDEDGSFSIRDVEETNMITLLVKLALITVSGLYPLAIPVTMALWYVWQVKTQRSGALWDVPSPSATQKATLSEGVYRIMQRGLFGKTQVGVGIHMEGVFHTMWHVTRGSVICHETGRLEPSWADVRNDMISYGGGWRLGDKWDKEEDVQVLAIEPGKNPKHVQTKPGLFKTLTGEIGAVTLDFKPGTSGSPIINKKGKVIGLYGNGVVTKSGDYVSAITQAERIGEPDYEVDEDIFRKKRLTIMDLHPGAGKTKRILPSIVREALKRRLRTLILAPTRVVAAEMEEALRGLPIRYQTPAVKSEHTGREIVDLMCHATFTTRLLSSTRVPNYNLIVMDEAHFTDPCSVAARGYISTRVEMGEAAAIFMTATPPGSIDPFPQSNSPIEDIEREIPERSWNTGFDWITDYQGKTVWFVPSIKAGNDIANCLRKSGKRVIQLSRKTFDTEYPKTKLTDWDFVVTTDISEMGANFRAGRVIDPRRCLKPVILTDGPERVILAGPIPVTPASAAQRRGRIGRNPAQEDDQYVFSGDPLKNDEDHAHWTEAKMLLDNIYTPEGIIPTLFGPEREKTQAIDGEFRLRGEQRKTFVELMRRGDLPVWLSYKVASAGISYKDREWCFTGERNNQILEENMEVEIWTREGEKKKLRPKWLDARVYADPMALKDFKEFASGRKSITLDILTEIATLPTYLSSKAKLALDNIVMLHTTEKGGRAYQHALNELPESLETLMLVALLGAMTAGIFLFFMQGKGIGKLSMGLIAIAVASGLLWVAEIQPQWIAASIILEFFLMVLLIPEPEKQRTPQDNQLIYVILTILTIIGLIAANEMGLIEKTKTDFGFYQVKPETTILDVDLRPASAWTLYAVATTILTPMLRHTIENTSANLSLAAIANQAAVLMGLGKGWPLHRMDLGVPLLAMGCYSQVNPTTLTASLVMLLVHYAIIGPGLQAKATREAQKRTAAGIMKNPTVDGITVIDLEPISYDPKFEKQLGQVMLLVLCVGQLLLMRTTWALCEVLTLATGPVMTLWEGNPGRFWNTTIAVSTANIFRGSYLAGAGLAFSLIKNAQTPRRGTGTTGETLGEKWKRQLNSLDRKEFEEYKRSGILEVDRTEAKSALRDGTKIKYAVSRGSSKIRWIVERGMIKPKGKVVDLGCGRGGWSYYMATLKNVTEVKGYTKGGPGHEEPIPMATYGWNLVKLHSGVDVFYKPTEQVDTLLCDIGESSSNPTIEEGRTLRVLKMVEPWLSSKPEFCIKVLNPYMPTVIEELEKLQRRHGGSLVRCPLSRNSTHEMYWVSGASGNIVSSVNTISKMLLNRFTTRHRKPTYEKDVDLGAGTRSVSTETEKPDMTVIGRRLQRLREEHKETWHYDQENPYRTWAYHGSYEAPSTGSASSMVNGVVKLLTKPWDVIPMVTQLAMTDTTPFGQQRVFKEKVDTRTPQPKPGTRMIMTTTANWLWALLGKKKSPRLCTREEFISKVRSNAAIGAVFQEEQGWTSASEAVNDSRFWELVDKERALHQEGKCESCVYNMMGKREKKLGEFGRAKGSRAIWYMWLGARFLEFEALGFLNEDHWFSRENSWSGVEGEGLHRLGYILEDIDKKDGDLIYADDTAGWDTRITEDDLLNEELITEQMAPHHKTLAKAIFKLTYQNKVVKVLRPTPKGAVMDIISRKDQRGSGQVGTYGLNTFTNMEVQLIRQMEAEGVITQDDMQNPKGLKERVEKWLKECGVDRLKRMAISGDDCVVKPLDERFSTSLLFLNDMGKVRKDIPQWEPSKGWKNWQEVPFCSHHFHKIFMKDGRSLVVPCRNQDELIGRARISQGAGWSLRETACLGKAYAQMWSLMYFHRRDLRLASMAICSAVPTEWFPTSRTTWSIHAHHQWMTTEDMLKVWNRVWIEDNPNMTDKTPVHSWEDIPYLGKREDLWCGSLIGLSSRATWAKNIHTAITQVRNLIGKEEYVDYMPAMKRYSAPFESEGVL

SEQ ID NO: 5211 - protein, 3288 aa, Artificial Sequence
  derived and/or modified protein sequence (wt) from DENV-4__JN638570__SS-prME
STITLLCLIPTVMAFHLSTRDGEPLMIVAKHERGRPLLFKTTEGINKCTLIAMDLGEMCEDTVTYKCPLLVNTEPEDIDCWCNLTSAWVMYGTCTQSGERRREKRSVALTPHSGMGLETRAETWMSSEGAWKHAQRVESWILRNPGFALLAGFMAYMIGQTGIQRTVFFILMMLVAPSYGMRCVGVGNRDFVEGVSGGAWVDLVLEHGGCVTTMAQGKPTLDFELIKTTAKEVALLRTYCIEASISNITTATRCPTQGEPYLKEEQDQQYICRRDMVDRGWGNGCGLFGKGGVVTCAKFSCLGKITGNLVQIENLEYTVVVTVHNGDTHAVGNDTSNHGVTATITPRSPSVEVKLPDYGELTLDCEPRSGIDFNEMILMKMKTKTWLVHKQWFLDLPLPWTTGADTLEVHWNHKERMVTFKVPHAKRQDVTVLGSQEGAMHSALAGATEVDSGDGNHMFAGHLKCKVRMEKLRIKGMSYTMCSGKFSIDKEMAETQHGTTVVKVKYEGTGAPCKVPIEIRDVNKEKVVGRIISSTPFAENTNSVTNIELEPPFGDSYIVIGVGDGALTLHWFRKGSSIGKMFESTYRGAKRMAILGETAWDFGSVGGLLTSLGKAVHQVFGSVYTTMFGGVSWMVRILIGLLVLWIGTNSRNTSMAMSCIAVGGITLFLGFTVHADMGCVVSWSGKELKCGSGIFVIDNVHTWTEQYKFQPESPARLASAILNAHKEGVCGIRSTTRLENVMWKQITNELNYVLWEGGHDLTVVAGDVKGVLSKGKRALAPPVNDLKYSWKTWGKAKIFTPETRNSTFLVDGPDTSECPNERRAWNFLEVEDYGFGMFTTNIWMKFREGSPEVCDHRLMSAAIKDQKAVHADMGYWIESSKNQTWQIEKASLIEVKTCLWPKTHTLWSNGVLESQMLIPKAYAGPISQHNYRQGYATQTAGPWHLGKLEIDFGECPGTTVTVQEDCDHRGPSLRTTTASGKLVTQWCCRSCTMPPLRFLGEDGCWYGMEIRPLNEKEENMVKSQVSAGQGTSETFSMGLLCLTLFVEECLRRRVTRKHMMLVVVTTLCAIILGGLTWMDLLRALIMLGDTMSGRMGGQIHLAIMAVFKMSPGYVLGIFLRKLTSRETALMVIGMAMTTVLAIPHDLMEFIDGISLGLILLKMVTHFDNTQVGTLALALTFIKSTMPLVMAWRTIMAVLFVVTLIPLCRTSCLQKQSHWVEITALILGAQALPVYLMTLMKGASKRSWPLNEGIMAVGLVSLLGSALLKNDVPLAGPMVAGGLLLAAYVMSGSSADLSLEKAANVRWDEMADITGSSPIIEVKQDEDGSFSIRDVEETNMITLLVKLALITVSGLYPLAIPVTMTLWYMWQVKTQRSGALWDVPSPAAAQKATLTEGVYRIMQRGLFGKTQVGVGIHTEGVFHTMWHVTRGSVICHESGRLEPSWADVRNDMISYGGGWRLGDKWDKEEDVQVLAIEPGKNPKHVQTKPGLFKTLTGEIGAVTLDFKPGTSGSPIINRKGKVIGLYGNGVVTKSGDYVSAITQAERIGEPDYEVDEDIFRKKRLTIMDLHPGAGKTKRILPSIVREALKRRLRTLILAPTRVVAAEMEEALRGLPIRYQTPAVKSEHTGREIVDLMCHATFTTRLLSSTRVPNYNLIVMDEAHFTDPSSVAARGYISTRVEMGEAAAIFMTATPPGTTDPFPQSNSPIEDIEREIPERSWNTGFDWITDYQGKTVWFVPSIKAGNDIANCLRKSGKKVIQLSRKTFDTEYPKTKLTDWDFVVTTDISEMGANFRAGRVIDPRRCLKPVILTDGPERVILAGPIPVTPASAAQRRGRIGRNPAQEDDQYVFSGDPLRNDEDHAHWTEAKMLLDNIYTPEGIIPTLFGPEREKTQAIDGEFRLRGEQRKTFVELMRRGDLPVWLSYKVASAGISYKDREWCFTGERNNQILEENMEVEIWTREGEKKKLRPKWLDARVYADPMALKDFKEFASGRKSITLDILTEIASLPTYLSSRAKLALDNIVMLHTTERGGKAYQHALNELPESLETLMLVALLGAMTAGIFLFFMQGKGIGKLSMGLIAIAVASGLLWVAEIQPQWIAASIILEFFLMVLLVPEPEKQRTPQDNQLIYVILTILTIIALVAANEMGLIEKTKTDFGFYQVKAETTILDVDLRPASAWTLYAVATTILTPMLRHTIENTSANLSLAAIANQAAVLMGLGKGWPLHRMDLGVPLLAMGCYSQVNPTTLTASLVMLLVHYAIIGPGLQAKATREAQKRTAAGIMKNPTVDGITVIDLEPISYDPKFEKQLGQVMLLVLCAGQLLLMRTTWAFCEVLTLATGPILTLWEGNPGRFWNTTIAVSTANIFRGSYLAGAGLAFSLIKNAQTPRRGTGTTGETLGEKWKRQLNSLDRKEFEEYKRSGILEVDRTEAKSALKDGSKIKYAVSRGTSKIRWIVERGMVKPKGKVVDLGCGRGGWSYYMATLKNVTEVKGYTKGGPGHEEPIPMATYGWNLVKLHSGVDVFYKPTEQVDTLLCDIGESSSNPTIEEGRTLRVLKMVEPWLSSKPEFCIKVLNPYMPTVIEELEKLQRRYGGSLVRCPLSRNSTHEMYWVSGVSGNIVSSVNTTSKMLLNRFTTRHRKPTYERDADLGAGTRSVSTETEKPDMTIIGRRLQRLQEEHKETWHYDHENPYRTWAYHGSYEAPSTGSASSMVNGVVKLLTKPWDVVPMVTQLAMTDTTPFGQQRVFKEKVDTRTPQPKPGTRVVMTTTANWLWTLLGRKKNPRLCTREEFISKVRSNAAIGAVFQEEQGWTSASEAVNDSRFWELVDKERALHQEGKCESCVYNMMGKREKKLGEFGRAKGSRAIWYMWLGARFLEFEALGFLNEDHWFGRENSWSGVEGEGLHRLGYILEDIDKKDGDLIYADDTAGWDTRITEDDLLNEELITEQMAPHHKILAKAIFKLTYQNKVVKVLRPTPKGAVMDIISRKDQRGSGQVGTYGLNTFTNMEVQLIRQMEAEGVITRDDMHNPKGLKERVEKWLKECGVDRLKRMAISGDDCVVKPLDERFSTSLLFLNDMGKVRKDIPQWEPSKGWKNWQEVPFCSHHFHKIFMKDGRSLVVPCRNQDELIGRARISQGAGWSLRETACLGKAYAQMWSLMYFHRRDLRLASMAICSAVPTEWFPTSRTTWSIHAHHQWMTTEDMLKVWNRVWIEDNPNMIDKTPVHSWEDIPYLGKREDLWCGSLIGLSSRATWAKNIHTAITQVRNLIGKEEYVDYMPAMRRYSAHFESEGVL

SEQ ID NO: 5212 - protein, 3288 aa, Artificial Sequence
  derived and/or modified protein sequence (wt) from DENV-4__JN638571__SS-prME
STITLLCLIPTVMAFHLSTRDGEPLMIVAKHERGRPLLFKTTEGINKCTLIAMDLGEMCEDTVTYKCPLLVNTEPEDIDCWCNLTSAWVMYGTCTQSGERRREKRSVALTPHSGMGLETRAETWMSSEGAWKHAQRVESWILRNPGFALLAGFMAYMIGQTGIQRTVFFILMMLVAPSYGMRCVGVGNRDFVEGVSGGAWVDLVLEHGGCVTTMAQGKPTLDFELIKTTAKEVALLRTYCIEASISNITTATRCPTQGEPYLKEEQDQQYICRRDMVDRGWGNGCGLFGKGGVVTCAKFSCLGKITGNLVQIENLEYTVVVTVHNGDTHAVGNDTSNHGVTATITPRSPSVEVKLPEYGELTLDCEPRSGIDFNEMILMKMKTKTWLVHKQWFLDLPLPWTTGADTLEVHWNHKERMVTFKVPHAKRQDVTVLGSQEGAMHSALAGATEVDSGDGNHMFAGHLKCKVRMEKLRIKGMSYTMCSGKFSIDKEMAETQHGTTVVKVKYEGTGAPCKVPIEIRDVNKEKVVGRIISSTPFAENTNSVTNIELEPPFGDSYIVIGVGDGALTLHWFRKGSSIGKMFESTYRGAKRMAILGETAWDFGSVGGLLTSLGKAVHQVFGSVYTTMFGGVSWMVRILIGLLVLWIGTNSRNTSMAMSCIAVGGITLFLGFTVHADMGCVVSWSGKELKCGSGIFVIDNVHTWTEQYKFQPESPARLASAILNAHKEGVCGIRSTTRLENVMWKQITNELNYVLWEGGHDLTVVAGDVKGVLSKGKRALAPPVNDLKYSWKTWGKAKIFTPETRNSTFLVDGPDTSECPNERRAWNFLEVEDYGFGMFTTNIWMKFREGSSEVCDHRLMSAAIKDQKAVHADMGYWIESSKNQTWQIEKASLIEVKTCLWPKTHTLWSNGVLESQMLIPKAYAGPISQHNYRQGYATQTAGPWHLGKLEIDFGECPGTTVTVQEDCDHRGPSLRTTTASGKLVTQWCCRSCTMPPLRFLGEDGCWYGMEIRPLNEKEENMVKSQVSAGQGTSETFSMGLLCLTLFVEECLRRRVTRKHMMLVVVTTLCAIILGGLTWMDLLRALIMLGDTMSGRMGGQIHLAIMAVFKMSPGYVLGIFLRKLTSRETALMVIGMAMTTVLAIPHDLMEFIDGISLGLILLKMVTHFDNTQVGTLALALTFIKSTMPLVMAWRTIMAVLFVVTLIPLCRTSCLQKQSHWVEITALILGAQALPVYLMTLMKGASKRSWPLNEGIMAVGLVSLLGSALLKNDVPLAGPMVAGGLLLAAYVMSGSSADLSLEKAANVRWDEMADITGSSPIIEVKQDEDGSFSIRDVEETNMITLLVKLALITVSGLYPLAIPVTMTLWYMWQVKTQRSGALWDVPSPAAAQKATLTEGVYRIMQRGLFGKTQVGVGIHTEGVFHTMWHVTRGSVICHESGRLEPSWADVRNDMISYGGGWRLGDKWDKEEDVQVLAIEPGKNPKHVQTKPGLFKTLTGEIGAVTLDFKPGTSGSPIINRKGKVIGLYGNGVVTKSGDYVSAITQAERIGEPDYEVDEDIFRKKRLTIMDLHPGAGKTKRILPSIVREALKRRLRTLILAPTRVVAAEMEEALRGLPIRYQTPAVKSEHTGREIVDLMCHATFTTRLLSSTRVPNYNLIVMDEAHFTDPSSVAARGYISTRVEMGEAAAIFMTATPPGTTDPFPQSNSPIEDIEREIPERSWNTGFDWITDYQGKTVWFVPSIKAGNDIANCLRKSGKKVIQLSRKTFDTEYPKTKLTDWDFVVTTDISEMGANFRAGRVIDPRRCLKPVILTDGPERVILAGPIPVTPASAAQRRGRIGRNPAQEDDQYVFSGDPLRNDEDHAHWTEAKMLLDNIYTPEGIIPTLFGPEREKTQAIDGEFRLRGEQRKTFVELMRRGDLPVWLSYKVASAGISYKDREWCFTGERNNQILEENMEVEIWTREGEKKKLRPKWLDARVYADPMALKDFKEFASGRKSITLDILTEIASLPTYLSSRAKLALDNIVMLHTTERGGKAYQHALNELPESLETLMLVALLGAMTAGIFLFFMQGKGIGKLSMGLIAIAVASGLLWVAEIQPQWIAASIILEFFLMVLLVPEPEKQRTPQDNQLIYVILTILTIIALVAANEMGLIEKTKTDFGFYQVKAETTILDVDLRPASAWTLYAVATTILTPMLRHTIENTSANLSLAAIANQAAVLMGLGKGWPLHRMDLGVPLLAMGCYSQVNPTTLTASLVMLLVHYAIIGPGLQAKATREAQKRTAAGIMKNPTVDGITVIDLEPISYDPKFEKQLGQVMLLVLCAGQLLLMRTTWAFCEVLTLATGPILTLWEGNPGRFWNTTIAVSTANIFRGSYLAGAGLAFSLIKNAQTPRRGTGTTGETLGEKWKRQLNSLDRKEFEEYKRSGILEVDRTEAKSALKDGSKIKYAVSRGTSKIRWIVERGMVKPKGKVVDLGCGRGGWSYYMATLKNVTEVKGYTKGGPGHEEPIPMATYGWNLVKLHSGVDVFYKPTEQVDTLLCDIGESSSNPTIEEGRTLRVLKMVEPWLSSKPEFCIKVLNPYMPTVIEELEKLQRRYGGSLVRCPLSRNSTHEMYWVSGVSGNIVSSVNTTSKMLLNRFTTRHRKPTYERDADLGAGTRSVSTETEKPDMTIIGRRLQRLQEEHKETWHYDHENPYRTWAYHGSYEAPSTGSASSMVNGVVKLLTKPWDVVPMVTQLAMTDTTPFGQQRVFKEKVDTRTPQPKPGTRVVMTTTANWLWTLLGRKKNPRLCTREEFISKVRLNAAIGAVFQEEQGWTSASEAVNDSRFWELVDKERALHQEGKCESCVYNMMGKREKKLGEFGRAKGSRAIWYMWLGARFLEFEALGFLNEDHWFGRENSWSGVEGEGLHRLGYILEDIDKKDGDLIYADDTAGWDTRITEDDLLNEELITEQMAPHHKILAKAIFKLTYQNKVVKVLRPTPKGAVMDIISRKDQRGSGQVGTYGLNTFTNMEVQLIRQMEAEGVITRDDMHNPKGLKERVEKWLKECGVDRLKRMAISGDDCVVKPLDERFSTSLLFLNDMGKVRKDIPQWEPSKGWKNWQEVPFCSHHFHKIFMKDGRSLVVPCRNQDELIGRARISQGAGWSLRETACLGKAYAQMWSLMYFHRRDLRLASMAICSAVPTEWFPTSRTTWSIHAHHQWMTTEDMLKVWNRVWIEDNPNMIDKTPVHSWEDIPYLGKREDLWCGSLIGLSSRATWAKNIHTAITQVRNLIGKEEYVDYMPAMRRYSAHFESEGVL

SEQ ID NO: 5213 - protein, 3288 aa, Artificial Sequence
  derived and/or modified protein sequence (wt) from DENV-4__JN638572__SS-prME
STITLLCLIPTVMAFHLSTRDGEPLMIVAKHERGRPLLFKTTEGINKCTLIAMDLGEMCEDTVTYKCPLLVNTEPEDIDCWCNLTSAWVMYGTCTQSGERRREKRSVALTPHSGMGLETRAETWMSSEGAWKHAQRVESWILRNPGFALLAGFMAYMIGQTGIQRTVFFILMMLVAPSYGMRCVGVGNRDFVEGVSGGAWVDLVLEHGGCVTTMAQGKPTLDFELIKTTAKEVALLRTYCIEASISNITTATRCPTQGEPYLKEEQDQQYICRRDMVDRGWGNGCGLFGKGGVVTCAKFSCLGKITGNLVQIENLEYTVVVTVHNGDTHAVGNDTSNHGVTATITPRSPSVEVKLPEYGELTLDCEPRSGIDFNEMILMKMKTKTWLVHKQWFLDLPLPWTTGADTLEVHWNHKERMVTFKVPHAKRQDVTVLGSQEGAMHSALAGATEVDSGDGNHMFAGHLKCKVRMEKLRIKGMSYTMCSGKFSIDKEMAETQHGTTVVKVKYEGTGAPCKVPIEIRDVNKEKVVGRIISSTPFAENTNSVTNIELEPPFGDSYIVIGVGDGALTLHWFRKGSSIGKMFESTYRGAKRMAILGETAWDFGSVGGLLTSLGKAVHQVFGSVYTTMFGGVSWMVRILIGLLVLWIGTNSRNTSMAMSCIAVGGITLFLGFTVHADMGCVVSWSGKELKCGSGVFVIDNVHTWTEQYKFQPESPARLASAILNAHKEGVCGIRSTTRLENVMWKQITNELNYVLWEGGHDLTVVAGDVKGVLSKGKRALAPPVNDLKYSWKTWGKAKIFTPETRNSTFLVDGPDTSECPNERRAWNFLEVEDYGFGMFTTNIWMKFREGSSEVCDHRLMSAAIKDQKAVHADMGYWIESSKNQTWQIEKASLIEVKTCLWPKTHTLWSNGVLESQMLIPKAYAGPISQHNYRQGYATQTAGPWHLGKLEIDFGECPGTTVTVQEDCDHRGPSLRTTTASGKLVTQWCCRSCTMPPLRFLGEDGCWYGMEIRPLNEKEENMVKSQVSAGQGTSETFSMGLLCLTLFVEECLRRRVTRKHMILVVVTTLCAIILGGLTWMDLLRALIMLGDTMSGRMGGQIHLAIMAVFKMSPGYVLGIFLRKLTSRETALMVIGMAMTTVLAIPHDLMEFIDGISLGLILLKMVTHFDNTQVGTLALALTFIKSTMPLVMAWRTIMAVLFVVTLIPLCRTSCLQKQSHWVEITALILGAQALPVYLMTLMKGASKRSWPLNEGIMAVGLVSLLGSALLKNDVPLAGPMVAGGLLLAAYVMSGSSADLSLEKAANVRWDEMADITGSSPIIEVKQDEDGSFSIRDVEETNMITLLVKLALITVSGLYPLAIPVTMTLWYMWQVKTQRSGALWDVPSPAAAQKATLTEGVYRIMQRGLFGKTQVGVGIHTEGVFHTMWHVTRGSVICHESGRLEPSWADVRNDMISYGGGWRLGDKWDKEEDVQVLAIEPGKNPKHVQTKPGLFKTLTGEIGAVTLDFKPGTSGSPIINRKGKVIGLYGNGVVTKSGDYVSAITQAERIGEPDYEVDEDIFRKKRLTIMDLHPGAGKTKRILPSIVREALKRRLRTLILAPTRVVAAEMEEALRGLPIRYQTPAVKSEHTGREIVDLMCHATFTTRLLSSTRVPNYNLIVMDEAHFTDPSSVAARGYISTRVEMGEAAAIFMTATPPGTTDPFPQSNSPIEDIEREIPERSWNTGFDWITDYQGKTVWFVPSIKAGNDIANCLRKSGKKVIQLSRKTFDTEYPKTKLTDWDFVVTTDISEMGANFRAGRVIDPRRCLKPVILTDGPERVILAGPIPVTPASAAQRRGRIGRNPAQEDDQYVFSGDPLRNDEDHAHWTEAKMLLDNIYTPEGIIPTLFGPEREKTQAIDGEFRLRGEQRKTFVELMRRGDLPVWLSYKVASAGISYKDREWCFTGERNNQILEENMEVEIWTREGEKKKLRPKWLDARVYADPMALKDFKEFASGRKSITLDILTEIASLPTYLSSRAKLALDNIVMLHTTERGGKAYQHALNELPESLETLMLVALLGAMTAGIFLFFMQGKGIGKLSMGLIAIAVASGLLWVAEIQPQWIAASIILEFFLMVLLVPEPEKQRTPQDNQLIYVILTILTIIALVAANEMGLIEKTKTDFGFYQVKAETTILDVDLRPASAWTLYAVATTILTPMLRHTIENTSANLSLAAIANQAAVLMGLGKGWPLHRMDLGVPLLAMGCYSQVNPTTLTASLVMLLVHYAIIGPGLQAKATREAQKRTAAGIMKNPTVDGITVIDLEPISYDPKFEKQLGQVMLLVLCVGQLLLMRTTWALCEVLTLATGPIMTLWEGNPGRFWNTTIAVSTANIFRGSYLAGAGLAFSLIKNAQTPRRGTGTTGETLGEKWKRQLNSLDRKEFEEYKRSGILEVDRTEAKSALRDGSKTKHAVSRGSSKIRWIVERGMIKPKGKVVDLGCGRGGWSYYMATLQNVTEVKGYTKGGPGHEEPIPMATYGWNLVKLHSGVDVFYKPTEQVDTLLCDIGESSSNPTIEEGRTLRVLKMVEPWLSSKPEFCIKVLNPYMPTVIEELEKLQRRYGGSLVRCPLSRNSTHEMYWVSGVSGNIVSSVNTTSKMLLNRFTTRHRKPTYERDADLGAGTRSVSTETEKPDMTIIGRRLQRLQEEHKETWHYDHENPYRTWAYHGSYEAPSTGSASSMVNGVVKLLTKPWDVVPMVTQLAMTDTTPFGQQRVFKEKVDTRTPQPKPGTRVVMTTTANWLWTLLGRKKNPRLCTREEFISKVRSNAAIGAVFQEEQGWTSASEAVNDSRFWELVDKERALHQEGKCESCVYNMMGKREKKLGEFGRAKGSRAIWYMWLGARFLEFEALGFLNEDHWFGRENSWSGVEGEGLHRLGYILEDIDKKDGDLIYADDTAGWDTRITEDDLLNEELITEQMAPHHKVLAKAIFKLTYQNKVVKVLRPTPKGAVMDIISRKDQRGSGQVGTYGLNTFTNMEVQLIRQMEAEGVITRDDMHNPKGLKERVEKWLKECGVDRLKRMAISGDDCVVKPLDERFSTSLLFLNDMGKVRKDIPQWEPSKGWKNWQEVPFCSHHFHKIFMKDGRSLVVPCRNQDELIGRARISQGAGWSLRETACLGKAYAQMWSLMYFHRRDLRLASMAICSAVPTEWFPTSRTTWSIHAHHQWMTTEDMLKVWNRVWIEDNPNMTDKTPVHSWEDIPYLGKREDLWCGSLIGLSSRATWAKNIHTAITQVRNLIGKEEYMDYMPVMKRYSAPSESEGVL

SEQ ID NO: 5214 - protein, 3288 aa, Artificial Sequence
  derived and/or modified protein sequence (wt) from DENV-4__JX024757__SS-prME
STMTLLCLIPTVMAFHLSTRDGEPLMIVAKHERGRPLLFKTTEGINKCTLIAMDLGEMCEDTVTYKCPLLVNTEPEDIDCWCNLTSTWVMYGTCTQSGERRREKRSVALTPHSGMGLETRAETWMSSEGAWKHAQRVESWILRNPGFALLAGFMAYMIGQTGIQRTVFFVLMMLVAPSYGMRCVGVGNRDFVEGVSGGAWVDLVLEHGGCVTTMAQGKPTLDFELTKTTAKEVALLRTYCIEASISNITTATRCPTQGEPYLKEEQDQQYICRRDVVDRGWGNGCGLFGKGGVVTCAKFLCSGKITGNLVQIENLEYTVVVTVHNGDTHAVGNDTSNHGVTATITPRSPSVEVKLPDYGELTLDCEPRSGIDFNEMILMKMKKKTWLVHKQWFLDLPLPWSAGADTSEVHWNYKERMVTFKVPHAKRQDVTVLGSQEGAMHSALAGATEVDSGDGNHMFAGHLKCKVRMEKLRIKGMSYTMCSGKFSIDKEMAETQHGTTVVKVKYEGAGAPCKVPIEIRDVNKEKVVGRIISSTPFAENTNSVTNIELEPPFGDSYIVIGVGDSALTLHWFRKGSSIGKMFESTYRGAKRMAILGETAWDFGSVGGLFTSLGKAVHQVFGSVYTTMFGGVSWMIRILIGFLVLWIGTNSRNTSMAMTCIAVGGITLFLGFTVQADMGCVVSWNGKELKCGSGIFVVDNVHTWTEQYKFQPESPARLASAILNAHKDGVCGIRSTTRLENVMWKQITNELNYVLWEGGHDLTVVAGDVKGVLTKGKRALTPPVNDLKYSWKTWGKAKIFTPEARNSTFLIDGPDTSECPNGRRAWNFLEVEDYGFGMFTTNIWMKFREGSSEVCDHRLMSAAIKDQKAVHADMGYWIESSKNQTWQIEKASLIEVKTCLWPKTHTLWSNGVLESQMLIPRSYAGPFSQHNYRQGYATQTAGPWHLGKLEIDFGECPGTTVTIQEDCDHRGPSLRTTTASGKLVTQWCCRSCTMPPLRFLGEDGCWYGMEIRPLSEKEENMVKSQVTAGQGTSETFSMGLLCLTLFVEECLRRRVTRKYMMLVVVITFCAIILGGLTWMDLLRALIMLGDTMSGRIGGQIHLAIMAVFKMSPGYVLGVFLRKLTSRETALMVIGMAMTTVFSIPHDLMELIDGISLGLILLRIVTHFDNTQVGTLALSLTFIRSTTPLVMAWRTIMAVFFVVTLIPLCRTSCLQKQSHWVEITALILGAQALPVYLMTLMKGASRRSWPLNEGIMAVGLVSLLGSALLKNDVPLAGPMVAGGLLLAAYVMSGSSADLSLEKAANVQWDEMADITGSSPIIEVKQDEDGSFSIRDVEETNMITLLVKLALITVSGLYPLAIPVTMALWYIWQVKTQRSGALWDVPSPAATQKATLSEGVYRIMQRGLFGKTQVGVGIHMEGVFHTMWHVTRGSVICHETGRLEPSWADVRNDMISYGGGWRLGDKWDKEEDVQVLAIEPGKNPKHVQTKPGLFKTLTGEIGAVTLDFKPGTSGSPIINKKGKVIGLYGNGVVTKSGDYVSAITQAERIGEPDYEVDEDIFRKKRLTIMDLHPGAGKTKRILPSIVREALKRRLRTLILAPTRVVAAEMEEALRGLPIRYQTPAVKSEHTGREIVDLMCHATFTTRLLSSTRVPNYNLIVMDEAHFTDPCSVAARGYISTRVEMGEAAAIFMTATPPGSIDPFPQSNSPIEDIEREIPERSWNTGFDWITDYQGKTVWFVPSIKAGNDIANCLRKSGKRVIQLSRKTFDTEYPKTKLTDWDFVVTTDISEMGANFRAGRVIDPRRCLKPVILTDGPERVILAGPIPVTPASAAQRRGRIGRNPAQEDDQYVFSGDPLKNDEDHAHWTEAKMLLDNIYTPEGIIPTLFGPEREKTQAIDGEFRLRGEQRKTFVELMRRGDLPVWLSYKVASAGISYKDREWCFTGERNNQILEENMEVEIWTREGEKKKLRPKWLDARVYADPMALKDFKEFASGRKSITLDILTEIATLPTYLSSKAKLALDNIVMLHTTEKGGRAYQHALNELPESLETLMLVALLGALTAGIFLFFMQGKGIGKLSMGLIAIAVASGLLWVAEIQPQWIAASIILEFFLMVLLIPEPEKQRTPQDNQLIYVILTILTIIGLIAANEMGLIEKTKTDFGFYQVKTETTILDVDLRPASAWTLYAVATTILTPMLRHTIENTSANLSLAAIANQAAVLMGLGKGWPLHRMDLGVPLLAMGCYSQVNPTTLTASLVMLLVHYAIIGPGLQAKATREAQKRTAAGIMKNPTVDGITVIDLEPISYDPKFEKQLGQVMLLVLCVGQLLLMRTTWALCEVLTLATGPIMTLWEGNPGRFWNTTIAVSTANIFRGSYLAGAGLAFSLIKNAQTPRRGTGTTGETLGEKWKRQLNSLDRKEFEEYKRSGILEVDRTEAKSALRDGSKIKHAVSRGSSKIRWIVERGMIKPKGKVVDLGCGRGGWSYYMATLKNVTEVKGYTKGGPGHEEPIPMATYGWNLVKLHSGVDVFYKPTEQVDTLLCDIGESSSNPTIEEGRTLRVLKMVEPWLSSKPEFCIKVLNPYMPTVIEELEKLQRRHGGSLVRCPLSRNSTHEMYWVSGASGNIVSSVNTISKMLLNRFTTRHRKPTYEKDVDLGAGTRSVSTETEKPDMTIIGRRLQRLREEHKETWHYDQENPYRTWAYHGSYEAPSTGSASSMVNGVVKLLTKPWDVIPMVTQLAMTDTTPFGQQRVFKEKVDTRTPQPKPGTRMIMTMTANWLWALLGKKKSPRLCTREEFISKVRSNAAIGAVFQEEQGWTSASEAVNDSRFWELVDKERALHQEGKCESCVYNMMGKREKKLGEFGRAKGSRAIWYMWLGARFLEFEALGFLNEDHWFSRENSWSGVEGEGLHRLGYILEDIDKKDGDLIYADDTAGWDTRITEDDLLNEELITEQMAPHHKTLAKAIFKLTYQNKVVKVLRPTPKGAVMDIISRKDQRGSGQVGTYGLNTFTNMEVQLIRQMEAEGVITQDDMQNPRGLKERVEKWLKECGVDRLKRMAISGDDCVVKPIDERFSTSLLFLNDMGKVRKDIPQWEPSKGWKNWQEVPFCSHHFHKIFMKDGRSLVVPCRNQDELIGRARISQGAGWSLRETACLGKAYAQMWSLMYFHRRDLRLASMAICSAVPTEWFPTSRTTWSIHAHHQWMTTEDMLKVWNRVWIEDNPNMTDKTPVHSWEDIPYLGKREDLWCGSLIGLSSRATWAKNIHTAITQVRNLIGKEEYVDYMPAMKRYSAPFESEGVL

SEQ ID NO: 5215 - protein, 3288 aa, Artificial Sequence
  derived and/or modified protein sequence (wt) from DENV-4__JF741967__SS-prME
STMTLLCLIPTVMAFHLSTRDGEPLMIVAKHERGRPLLFKTTEGINKCTLIAMDLGEMCEDTVTYKCPLLVNTEPEDIDCWCNLTSTWVMYGTCTQSGERRREKRSVALTPHSGMGLETRAETWMSSEGAWKHAQRVESWILRNPGFALLAGFMAYMIGQTGIQRTVFFVLMMLVAPSYGMRCVGVGNRDFVEGVSGGAWVDLVLEHGGCVTTMAQGKPTLDFELTKTTAKEVALLRTYCIEASISNITTATRCPTQGEPYLKEEQDQQYICRRDVVDRGWGNGCGLFGKGGVVTCAKFLCSGKITGNLVQIENLEYTVVVTVHNGNTHAVGNDTSNHGVTATITPRSPSVEVKLPDYGELTLDCEPRSGIDFNEMILMKMKKKTWLVHKQWFLDLPLPWTAGADTSEVHWNYKERMVTFKVPHAKRQDVTVLGSQEGAMHSALAGATEVDSGDGNHMFAGHLKCKVRMEKLRIKGMSYTMCSGKFSIDKEMAETQHGTTVVKVKYEGAGAPCKVPIEIRDVNKEKVVGRIISSTPFAENTNSVTNIELEPPFGDSYIVIGVGDSALTLHWFRKGSSIGKMFESTYRGAKRMAILGETAWDFGSVGGLFTSLGKAVHQVFGSVYTTMFGGVSWMIRILIGFLVLWIGTNSRNTSMAMTCIAVGGITLFLGFTVQADMGCVVSWNGKELKCGSGIFVVDNVHTWTEQYKFQPESPARLASAILNAHKDGVCGIRSTTRLENVMWKQITNELNYVLWEGGHDLTVVAGDVKGVLTKGKRALTPPVNDLKYSWKTWGKAKIFTPEARNSTFLIDGPDTSECPNERRAWNFFEVEDYGFGMFTTNIWMKFREGSSEVCDHRLMSAAIKDQKAVHADMGYWIESSKNQTWQIEKASLIEVKTCLWPKTHTLWSNGVLESQMLIPRSYAGPFSQHNYRQGYATQTAGPWHLGKLEIDFGECPGTTVTIQEDCDHRGPSLRTTTASGKLVTQWCCRSCTMPPLRFLGEDGCWYGMEIRPLSEKEENMVKSQVTAGQGTSETFSMGLLCLTLFVEECLRRRVTRKHMILAVVITFCAIILGGLTWMDLLRVLIMLGDTMSGRIGGQIHLAIMAVFKMSPGYVLGVFLRKLTSRETALMVIGMAMTTVFSIPHDLMELIDGISLGLILLKIVTHFDNTQVGTLALSLTFIRSTTPLVMAWRTIMAVFFVVTLIPLCRTSCLQKQSHWVEITALILGAQALPVYLMTLMKGASRRSWPLNEGIMAVGLVSLLGSALLKNDVPLAGPMVAGGLLLAAYVMSGSSADLSLEKAANVQWDEMADITGSSPIIEVKQDEDGSFSIREVEETNMITLLVKLALITVSGLYPLAIPVTMALWYVWQVKTQRSGALWDVPSPAATHKATLSEGVYRIMQRGLFGKTQVGVGIHMEGVFHTVGHVTRGSVICHETGRLEPSWGDVRNDMISYGGGWRLGDKWDKEEDVQVLAIEPGKNPKHVQTKPGLFKTLTGEIGAVTLDFKPGTSGSPIINKKGKVIGLYGNGVVTKSGDYVSAITQAERIGEPDYEVDEDIFRKKRLTIMDLHPGAGKTKRILPSIVREALKRRLRTLILAPTRVVAAEMEEALRGLPIRYQTPAVKSEHTGREIVDLMCHATFTTRLLSSTRVPNYNLIVMDEAHFTDPCSVAARGYISTRVEMGEAAAIFMTATPPGSIDPFPQSNSPIEDIEREIPERSWNTGFDWITDYQGKTVWFVPSIKAGNDIANCLRKSGKRVIQLSRKTFDTEYPKTKLTDWDFVVTTDISEMGANFRAGRVIDPRRCLKPVILTDGPERVILAGPIPVTPASAAQRRGRIGRNPAQEDDQYVFSGDPLKNDEDHAHWTEAKMLLDNIYTPEGIIPTLFGPEREKTQAIDGEFRLRGEQRKTFVELMRRGDLPVWLSYKVASAGISYKDREWCFTGERNNQILEENMEVEIWTREGEKKKLRPKWLDARVYADPMALKDFKEFASGRKSITLDILTEIATLPTYLSSKAKLALDNIVMLHTTEKGGRAYQHALNELPESLETLMLVALLGAMTAGIFLFFMQGKGIGKLSMGLIAIAVASGLLWVAEIQPQWIAASIILEFFLMVLLIPEPEKQRTPQDNQLIYVILTILTIIGLIAANEMGLIEKTKTDFGFYQVKPETTILDVDLRPASAWTLYAVATTILTPMLRHTIENTSANLSLAAIANQAAVLMGLGKGWPLHRMDLGVPLLAMGCYSQVNPTTLTASLVMLLVHYAIIGPGLQAKATREAQKRTAAGIMKNPTVDGITVIDLEPISYDPKFEKQLGQVMLLVLCVGQLLLMRTTWALCEVLTLATGPVMTLWEGNPGRFWNTTIAVSTANIFRGSYLAGAGLAFSLIKNAQTPRRGTGTTGETLGEKWKRQLNSLDRKEFEEYKRSGILEVDRTEAKSALRDGTKIKYAVSRGSSKIRWIVERGMIKPKGKVVDLGCGRGGWSYYMATLKNVTEVKGYTKGGPGHEEPIPMATYGWNLVKLHSGVDVFYKPTEQVDTLLCDIGESSSNPTIEEGRTLRVLKMVEPWLSSKPEFCIKVLNPYMPTVIEELEKLQRRHGGSLVRCPLSRNSTHEMYWVSGASGNIVSSVNTISKMLLNRFTTRHRKPTYEKDVDLGAGTRSVSTETEKPDMTVIGRRLQRLREEHKETWHYDQENPYRTWAYHGSYEAPSTGSASSMVNGVVKLLTKPWDVIPMVTQLAMTDTTPFGQQRVFKEKVDTRTPQPKPGTRMIMTTTANWLWALLGKKKSPRLCTREEFISKVRSNAAIGAVFQEEQGWTSASEAVNDSRFWELVDKERALHQEGKCESCVYNMMGKREKKLGEFGRAKGSRAIWYMWLGARFLEFEALGFLNEDHWFSRENSWSGVEGEGLHRLGYILEDIDKKDGDLIYADDTAGWDTRITEDDLLNEELITEQMAPHHKTLAKAIFKLTYQNKVVKVLRPTPKGAVMDIISRKDQRGSGQVGTYGLNTFTNMEVQLIRQMEAEGVITQDDMQNPKGLKERVEKWLKECGVDRLKRMAISGDDCVVKPLDERFSTSLLFLNDMGKVRKDIPQWEPSKGWKNWQEVPFCSHHFHKIFMKDGRSLVVPCRNQDELIGRARISQGAGWSLRETACLGKAYAQMWSLMYFHRRDLRLASMAICSAVPTEWFPTSRTTWSIHAHHQWMTTEDMLKVWNRVWIEDNPNMTDKTPVHSWEDIPYLGKREDLWCGSLIGLSSRATWAKNIHTAITQVRNLIGKEEYVDYMPAMKRYSAPFESEGVL

SEQ ID NO: 5216 - protein, 3288 aa, Artificial Sequence
  derived and/or modified protein sequence (wt) from DENV-4__JQ822247__SS-prME
STMTLLCLIPTVMAFHLSTRDGEPLMIVAKHERGRPLLFKTTEGINKCTLIAMDLGEMCEDTVTYKCPLLVNTEPEDIDCWCNLTSTWVMYGTCTQSGERRREKRSVALTPHSGMGLETRAETWMSSEGAWKHAQRVESWILRNPGFALLAGFMAYMIGQTGIQRTVFFVLMMLVAPSYGMRCVGVGNRDFVEGVSGGAWVDLVLEHGGCVTTMAQGKPTLDFELTKTTAKEVALLRTYCIEASISNITTATRCPTQGEPYLKEEQDQQYICRRDVVDRGWGNGCGLFGKGGVVTCAKFLCSGKITGNLVQIENLEYTVVVTVHNGNTHAVGNDTSNHGVTATITPRSPSVEVKLPDYGELTLDCEPRSGIDFNEMILMKMKKKTWLVHKQWFLDLPLPWTAGADTSEVHWNYKERMVTFKVPHAKRQDVTVLGSQEGAMHSALAGATEVDSGDGNHMFAGHLKCKVRMEKLRIKGMSYTMCSGKFSIDKEMAETQHGTTVVKVKYEGAGAPCKVPIEIRDVNKEKVVGRIISSTPFAENTNSVTNIELEPPFGDSYIVIGVGDSALTLHWFRKGSSIGKMFESTYRGAKRMAILGETAWDFGSVGGLFTSLGKAVHQVFGSVYTTMFGGVSWMIRILIGFLVLWIGTNSRNTSMAMTCIAVGGITLFLGFTVQADMGCVVSWNGKELKCGSGIFVVDNVHTWTEQYKFQPESPARLASAILNAHKDGVCGIRSTTRLENVMWKQITNELNYVLWEGGHDLTVVAGDVKGVLTKGKRALTPPVNDLKYSWKTWGKAKIFTPEARNSTFLIDGPDTSECPNERRAWNFFEVEDYGFGMFTTNIWMKFREGSSEVCDHRLMSAAIKDQKAVHADMGYWIESSKNQTWQIEKASLIEVKTCLWPKTHTLWSNGVLESQMLIPRSYAGPFSQHNYRQGYATQTAGPWHLGKLEIDFGECPGTTVTIQEDCDHRGPSLRTTTASGKLVTQWCCRSCTMPPLRFLGEDGCWYGMEIRPLSEKEENMVKSQVTAGQGTSETFSMGLLCLTLFVEECLRRRVTRKHMILAVVITFCAIILGGLTWMDLLRVLIMLGDTMSGRIGGQIHLAIMAVFKMSPGYVLGVFLRKLTSRETALMVIGMAMTTVFSIPHDLMELIDGISLGLILLKIVTHFDNTQVGTLALSLTFIRSTTPLVMAWRTIMAVFFVVTLIPLCRTSCLQKQSHWVEITALILGAQALPVYLMTLMKGASRRSWPLNEGIMAVGLVSLLGSALLKNDVPLAGPMVAGGLLLAAYVMSGSSADLSLEKAANVQWDEMADITGSSPIIEVKQDEDGSFSIRDVEETNMITLLVKLALITVSGLYPLAIPVTMALWYVWQVKTQRSGALWDVPSPAATQKATLSEGVYRIMQRGLFGKTQVGVGIHMEGVFHTMWHVTRGSVICHETGRLEPSWADVRNDMISYGGGWRLGDKWDKEEDVQVLAIEPGKNPKHVQTKPGLFKTLTGEIGAVTLDFKPGTSGSPIINKKGKVIGLYGNGVVTKSGDYVSAITQAERIGEPDYEVDEDIFRKKRLTIMDLHPGAGKTKRILPSIVREALKRRLRTLILAPTRVVAAEMEEALRGLPIRYQTPAVKSEHTGREIVDLMCHATFTTRLLSSTRVPNYNLIVMDEAHFTDPCSVAARGYISTRVEMGEAAAIFMTATPPGSIDPFPQSNSPIEDIEREIPERSWNTGFDWITDYQGKTVWFVPSIKAGNDIANCLRKSGKRVIQLSRKTFDTEYPKTKLTDWDFVVTTDISEMGANFRAGRVIDPRRCLKPVILTDGPERVILAGPIPVTPASAAQRRGRIGRNPAQEDDQYVFSGDPLKNDEDHAHWTEAKMLLDNIYTPEGIIPTLFGPEREKTQAIDGEFRLRGEQRKTFVELMRRGDLPVWLSYKVASAGISYKDREWCFTGERNNQILEENMEVEIWTREGEKKKLRPKWLDARVYADPMALKDFKEFASGRKSITLDILTEIATLPTYLSSKAKLALDNIVMLHTTEKGGRAYQHALNELPESLETLMLVALLGAMTAGIFLFFMQGKGIGKLSMGLIAIAVASGLLWVAEIQPQWIAASIILEFFLMVLLIPEPEKQRTPQDNQLIYVILTILTIIGLIAANEMGLIEKTKTDFGFYQVKPETTILDVDLRPASAWTLYAVATTILTPMLRHTIENTSANLSLAAIANQAAVLMGLGKGWPLHRMDLGVPLLAMGCYSQVNPTTLTASLVMLLVHYAIIGPGLQAKATREAQKRTAAGIMKNPTVDGITVIDLEPISYDPKFEKQLGQVMLLVLCVGQLLLMRTTWALCEVLTLATGPVMTLWEGNPGRFWNTTIAVSTANIFRGSYLAGAGLAFSLIKNAQTPRRGTGTTGETLGEKWKRQLNSLDRKEFEEYKRSGILEVDRTEAKSALRDGTKIKYAVSRGSSKIRWIVERGMIKPKGKVVDLGCGRGGWSYYMATLKNVTEVKGYTKGGPGHEEPIPMATYGWNLVKLHSGVDVFYKPTEQVDTLLCDIGESSSNPTIEEGRTLRVLKMVEPWLSSKPEFCIKVLNPYMPTVIEELEKLQRRHGGSLVRCPLSRNSTHEMYWVSGASGNIVSSVNTISKMLLNRFTTRHRKPTYEKDVDLGAGTRSVSTETEKPDMTVIGRRLQRLREEHKETWHYDQENPYRTWAYHGSYEAPSTGSASSMVNGVVKLLTKPWDVIPMVTQLAMTDTTPFGQQRVFKEKVDTRTPQPKPGTRMIMTTTANWLWALLGKKKSPRLCTREEFISKVRSNAAIGAVFQEEQGWTSASEAVNDSRFWELVDKERALHQEGKCESCVYNMMGKREKKLGEFGRAKGSRAIWYMWLGARFLEFEALGFLNEDHWFSRENSWSGVEGEGLHRLGYILEDIDKKDGDLIYADDTAGWDTRITEDDLLNEELITEQMAPHHKTLAKAIFKLTYQNKVVKVLRPTPKGAVMDIISRKDQRGSGQVGTYGLNTFTNMEVQLIRQMEAEGVITQDDMQNPKGLKERVEKWLKECGVDRLKRMAISGDDCVVKPLDERFSTSLLFLNDMGKVRKDIPQWEPSKGWKNWQEVPFCSHHFHKIFMKDGRSLVVPCRNQDELIGRARISQGAGWSLRETACLGKAYAQMWSLMYFHRRDLRLASMAICSAVPTEWFPTSRTTWSIHAHHQWMTTEDMLKVWNRVWIEDNPNMTDKTPVHSWEDIPYLGKREDLWCGSLIGLSSRATWAKNIHTAITQVRNLIGKEEYVDYMPAMKRYSAPFESEGVL

SEQ ID NO: 5217 - protein, 3288 aa, Artificial Sequence
  derived and/or modified protein sequence (wt) from DENV-4__JF262783__SS-prME
STVTLLCLIPTVMAFHLSTRDGEPLMIVAKHERGRPLLFKTTEGINKCTLIAMDLGEMCEDTVMYKCPLLVNTEPEDIDCWCNLTSTWVMYGTCTQSGERRREKRSVALTPHSGMGLETRAETWMSSEGAWKHAQRVESWILRNPGFALLAGFMAYMIGQTGIQRTVFFVLMMLVAPSYGMRCVGVGNRDFVEGVSGGAWVDLVLEHGGCVTTMAQGKPTLDFELIKTTAKEVTLLRTYCIEASISNITTATRCPTQGEPYLKEEQDQQYICRRDVVDRGWGNGCGLFGKGGVVTCAKFLCSGKITGNLVQIENLEYTVVVTVHNGDTHVVGKDTSNHGVTATITPRSPSVEVKLPDYGELTLDCEPRSGIDFNEMILMKMKKKTWLVHKQWFLDLPLPWTAGADTSEVQWNYKERMVTFKVPHAKRQDVTVLGSQEGAMHSALTGATEVDSGDGNHMFAGHLKCKVRMEKLRIKGMSYTMCSGKFSIDKEMAETQHGTTVVKVKYEGAGAPCKVPIEIRDVNKEKVVGRIISSTPFAENTNSVTNIELEPPFGDSYIVIGVGDSALTLHWFRKGSSIGKMFESTYRGAKRMAILGETAWDFGSVGGLFTSLGKAVHQVFGSVYTTMFGGVSWMVRILIGLLVLWIGTNSRNTSMAMTCIAIGGITLFLGFTVHADMGCAVSWSGKELKCGSGIFVIDNVHTWTEQYKFQPESPARLASAILNAHKDGVCGIRSTTRLENVMWKQITNELNYVLWEGGHDLTVVAGDVKGVLTKGKRALTPPVNDLKYSWKTWGKAKIFTPEARNSTFLIDGPDTSECPNERRAWNFLEVEDYGFGMFATNIWMKFREGSSEVCDHRLMSAAIKDQKAVHADMGYWIESSKNQTWQIEKASLIEVKTCLWPKTHTLWSNEVLESQMLIPKAYAGPFSQHNYRQGYATQTIGPWHLGKLEIDFGECPGTTVTIQEDCNHRGPSLRTTTASGKLVTQWCCRSCTMPPLRFLGEDGCWYGMEIRPLSEKEENMVKSQVSAGQGTSETFSMGLLCLTLFVEECLRRRVTRKHMILVVVTTLCAIILGGLTWMDLLRALIMLGDTMSGRMGGQIHLTIMAVFKMSPGYVLGVFLRKLTSRETALIVIGMAMTTVLSIPHDLMEFIDGISLGLILLKMVAHFDNTQVGTLALSLTFIRSTMPLVMAWRTIMAVLFVVTLIPLCRTSCLQKQSHWVEITALILGAQALPVYLMTLMKGASKRSWPLNEGIMAVGLVSLLGSALLKNDVPLAGPMVAGGLLLAAYVMSGSSADLSLEKAANVQWDEMADITGSSPIIEVKQDEDGSFSIRDVEETNMITLLVKLALITVSGLYPLAIPVTMALWYMWQVKTQRSGALWDVPSPAAAQKATLTEGVYRIMQRGLFGKTQVGVGIHMEGVFHTMWHVTRGSVICHETGRLEPSWADVRNDMISYGGGWRLGDKWDKEEDVQVLAIEPGKNPKHVQTKPGLFKTLTGEIGAVTLDFKPGTSGSPIINKKGRVIGLYGNGIVTKSGDYVSAITQAERIGEPDYEVDEDIFRKKRLTVMDLHPGAGKTKRILPSIVREALKRRLRTLILAPTRVVAAEMEEALRGLPIRYQTPAVKSEHTGREIVDLMCHATFTTRLLSSTRVPNYNLIVMDEAHFTDPSSVAARGYISTRVEMGEAAAIFMTATPPGATDPFPQSNSPIEDIEREIPERSWNTGFDWITDYQGKTVWFVPSIKAGNDIANCLRKSGKKVIQLSRKTFDTEYPKTKLTDWDFVVTTDISEMGANFRARRVIDPRRCLKPVILTDGPERVILAGPIPVTPASAAQRRGRIGRNPAQEDDQYVFSGDPLKNDEDHAHWTEAKMLLDNIYTPEGIIPTLFGPEREKIQAIDGEFRLRGEQRKTFVELMRRGDLPVWLSYKVASAGISYKDREWCFTGERNNQILEENMEVEIWTREGEKKKLRPKWLDARVYADPMALKDFKEFASGRKSITLDILTEIASLPTYLSSRAKLALDNIVMLHTTERGGRAYQHALNELPESLETLMLVALLGAMTAGIFLFFMQGKGIGKLSMGLMAIAVASGLLWVAEIQPQWIAASIILEFFLMALLIPEPEKQRTPQDNQLIYVILTILTIIGLIAANEMGLIEKTKTDFGFYQVKTETTILDVDLRPASAWTLYAVATTILTPMLRHTIENTSANLSLAAIANQAAVLMGLGKGWPLHRMDLGVPLLAMGCYSQVNPTTLTASLVMLSVHYAIIGPGLQAKATREAQKRTAAGIMKNPTVDGITVIDLEPISYDPKFEKQLGQVMLLALCAGQLLLMRTTWAFCEVLTLATGPILTLWEGNPGRFWNTTIAVSTANIFRGSYLAGAGLAFSLIKNAQTPRRGTGTTGETLGEKWKRQLNSLDRKEFEEYKRSGILEVDRTEAKSALKDGSKIKHAVSRGSSKIRWIVERGMVKPKGKVVDLGCGRGGWSYYMATLKNVTEVKGYTKGGPGHEEPIPMATYGWNLVKLHSGVDVFYKPTEQVDTLLCDIGESSSNPTIEEGRTLRVLKMVEPWLSSKPEFCIKVLNPYMPTVIEELEKLQRKHGGSLVRCPLSRNSTHEMYWVSGASGNIVSSVNTTSKMLLNRFTTRHRKPTYEKDVNLGAGTRSVSTETEKPDMTIIGRRLQRLREEHKETWHYDQENPYRTWAYHGSYEAPSTGSASSMVNGVVKLLTKPWDVIPMVTQLAMTDTTPFGQQRVFKEKVDTRTPQPKPGTRMVMTTTANWLWALLGKKKSPRLCTREEFISKVRSNAAIGAVFQEEQGWTSASEAVNDSRFWELVDKERALHQEGKCESCVYNMMGKREKKLGEFGRAKGSRAIWYMWLGARFLEFEALGFLNEDHWFGRENSWSGVEGEGLHRLGYILEDIDKKDGDLIYADDTAGWDTRITEDDLLNEELITEQMAPHHRILAKAIFKLTYQNKVVKVLRPTPKGAVMDIISRKDQRGSGQVGTYGLNTFTNMEVQLIRQMEAEGVITQDDMQNPKGLKERVEKWLKECGVDRLKRMAISGDDCVVKPLDERFSTSLLFLNDMGKVRKDIPQWEPSKGWKNWQEVPFCSHHFHKIFMKDGRSLVVPCRNQDELIGRARISQGAGWSLRETACLGKAYAQMWSLMYFHRRDLRLASMAICSAVPTEWFPTSRTTWSIHAHHQWMTTEDMLKVWNRVWIEDNPNMTDKTPVHSWEDIPYLGKREDLWCGSLIGLSSRATWAKNIHTAITQVRNLIGKEEYVDYMPVMKRYSAPFESEGVL

SEQ ID NO: 5218 - protein, 3288 aa, Artificial Sequence
  derived and/or modified protein sequence (wt) from DENV-4__KU513441__SS-prME
STITLLCLIPTVMAFHLSTRDGEPLMIVAKHERGRPLLFKTTEGINKCTLIAMDLGEMCEDTVTYKCPLLVNTEPEDIDCWCNLTSTWVMYGTCTQSGERRREKRSVALTPHSGMGLETRAETWMSSEGAWKHAQRVESWILRNPGFALLAGFMAYMIGQTGIQRTVFFVLMMLVAPSYGMRCVGVGNRDFVEGVSGGAWVDLVLEHGGCVTTMAQGKPTLDFELTKTTAKEVALLRTYCIEALISNITTATRCPTQGEPYLKEEQDQQYICRRDVVDRGWGNGCGLFGKGGVVTCAKFSCSGKITGNLVQIENLEYTVVVTVHNGDTHAVGNDTSNHGVTATITPRSPSVEVKLPDYGELTLDCEPRSGIDFNEMILMKMKKKTWLVHKQWFLDLPLPWTTGADTSEVHWNYKERMVTFKVPHAKRQDVTVLGSQEGAMHSALAGATEVDSGDGNHMFAGHLKCKVRMEKLRIKGMSYTMCSGKFSIDKEMAETQHGTTVVKVKYEGAGAPCKVPIEIRDVNKERVVGRVISATPLAENTNSVTNIELEPPFGDSYIVIGVGNSALTLHWFRKGSSIGKMFESTYRGAKRMAILGETAWDFGSVGGLFTSLGKAVHQVFGSVYTTMFGGVSWMIRILIGFLVLWIGTNSRNTSMAMTCIAVGGITLFLGFTVQADMGCVVSWSGRELKCGSGIFVVDNVHTWTEQYKFQPESPARLASAILNAHKDGVCGIRSTTRLENVMWKQITNELNYVLWEGGHDLTVVAGDVKGVLTKGKRALTPPASDLKYSWKTWGKAKIFTPEARNSTFLIDGPDTSECPNERRAWNSFEVEDYGFGMFTTNIWMKFREGSSEVCDHRLMSAAIKDQKAVHADMGYWIESSKNQTWQIERASLIEVKTCLWPKTHTLWSNGVLESQMLIPKSYAGPFSQHNYRQGYATQTVGPWHLGKLEIDFGECPGTTVTIQENCDHRGPSLRTTTASGKLVTQWCCRSCTMPPLRFLGEDGCWYGMEIRPLSEKEENMVKSQVTAGQGTSETFSMGLLCLTLFVEECLRRRVTRKHMILAVVITLCAIILGGLTWMDLLRALIMLGDTMSGRIGGQTHLAIIAVFKMSPGYVLGVFLRKLTSRETALMVIGMAMTTTLSIPHDLMELIDGISLGLILLKIVTQFDNTQVGTLALSLTFIRSTMSLVMAWRTIMAVLFVVTLIPLCRTSCLQKQSHWVEITALILGAQALPVYLMTLMKGASRRSWPLNEGIMAVGLVSLLGSALLKNDVPLAGPMVAGGLLLAAYVMSGSSADLSLEKAANVQWDEMADITGSSPIIEVKQDEDGSFSIRDVEETNMITLLVKLALITVSGLYPLAIPITMTLWYMWQVKTQRSGALWDVPSPAATQKAALSEGVYRIMQRGLFGKTQVGVGIHMEGVFHTMWHVTRGSVICHETGRLEPSWADVRNDMISYGGGWRLGDKWDKEEDVQVLAIEPGKNPKHVQTKPGLFKTLTGEIGAVTLDFKPGTSGSPIINRKGKVIGLYGNGVVTKSGDYVSAITQAERIGEPDYEVDEDIFRKKRLTIMDLHPGAGKTKRILPSIVREALKRRLRTLILAPTRVVAAEMEEALRGLPIRYQTPAVKSEHTGREIVDLMCHATFTTRLLSSTRVPNYNLIVMDEAHFTDPSSVAARGYISTRVEMGEAAAIFMTATPPGATDPFPQSNSPIEDIEREIPERSWNTGFDWITDYQGKTVWFVPSIKAGNDIANCLRKSGKKVIQLSRKTFDTEYPKTKLTDWDFVVTTDISEMGANFRAGRVIDPRRCLKPVILTDGPERVILAGPIPVTPASAAQRRGRIGRNPAQEDDQYVFSGDPLKNDEDHAHWTEAKMLLDNIYTPEGIIPTLFGPEREKTQAIDGEFRLRGEQRKTFVELMRRGDLPVWLSYKVASAGISYKDREWCFTGERNNQILEENMEVEIWTREGEKKKLRPKWLDARVYADPMALKDFKEFASGRKSITLDILTEIASLPTYLSSRAKLALDNIVMLHTTERGGRAYQHALNELPESLETLMLVALLGAMTAGIFLFFMQGKGIGKLSMGLITIAVASGLLWVAEIQPQWIAASIILEFFLMVLLIPEPEKQRTPQDNQLIYVILTILTIIGLIAANEMGLIEKTKTDFGFYQVKTETTILDVDLRPASAWTLYAVATTILTPMLRHTIENTSANLSLAAIANQAAVLMGLGKGWPLHRMDLGVPLLAMGCYSQVNPTTLTASLVMLLVHYAIIGPGLQAKATREAQKRTAAGIMKNPTVDGITVIDLEPISYDPKFEKQLGQVMLLVLCAGQLLLMRTTWAFCEVLTLATGPILTLWEGNPGRFWNTTIAVSTANIFRGSYLAGAGLAFSLIKNAQTPRRGTGTAGETLGEKWKRQLNSLDRKEFEEYKRSGILEVDRTEAKSALKDGSKIKHAVSRGSSKIRWIVERGMVKPKGKVVDLGCGRGGWSYYMATLKNVTEVKGYTKGGPGHEEPIPMATYGWNLVKLHSGVDVFYKPTEQVDTLLCDIGESSSNPTIEEGRTLRVLKMVEPWLSSKPEFCIKVLNPYMPTVIEELEKLQRKHGGNLVRCPLSRNSTHEMYWVSGASGNIVSSVNTTSKMLLNRFTTRHRKPTYEKDVDLGAGTRSVSTEIEKPDMTIIGRRLQRLQEEHKETWHYDQENPYRTWAYHGSYEAPSTGSASSMVNGVVKLLTKPWDVIPMVTQLAMTDTTPFGQQRVFKEKVDTRTPQPKPGTRMVMTTTANWLWALLGKKKNPRLCTREEFISKVRSNAAIGAVFQEEQGWTSASEAVNDSRFWELVDKERALHQEGKCESCVYNMMGKREKKLGEFGRAKGSRAIWYMWLGARFLEFEALGFLNEDHWFGRENSWSGVEGEGLHRLGYILEEIDKKDGDLMYADDTAGWDTRITEDDLQNEELITEQMAPHHKILAKAIFKLTYQNKVVKVLRPTPRGAVMDIISRKDQRGSGQVGTYGLNTFTNMEVQLIRQMEAEGVITQDDMQNPKGLKERVEKWLRECGVDRLKRMAISGDDCVVKPLDERFGTSLLFLNDMGKVRKDIPQWEPSKGWKNWQEVPFCSHHFHKIFMKDGRSLVVPCRNQDELIGRARISQGAGWSLRETACLGKAYAQMWSLMYFHRRDLRLASMAICSAVPTEWFPTSRTTWSIHAHHQWMTTEDMLKVWNRVWIEDNPNMIDKTPVHSWEDIPYLGKREDLWCGSLIGLSSRATWAKNIHTAITQVRNLIGKEEYVDYMSVMKRYSAPSESEGVL

SEQ ID NO: 5219 - protein, 3288 aa, Artificial Sequence
  derived and/or modified protein sequence (wt) from DENV-4__KC762694__SS-prME
STMTLLCLIPTVMAFHLSTRDGEPLMIVAKHERGRPLLFKTTEGINKCTLIAMDLGEMCEDTVTYKCPLLVNTEPEDIDCWCNLTSTWVMYGTCTQSGERRREKRSVALTPHSGMGLETRAETWMSSEGAWKHAQRVESWILRNPGFALLAGFMAYMIGQTGIQRTVFFVLMMLVAPSYGMRCVGVGNRDFVEGVSGGAWVDLVLEHGGCVTTMAQGKPTLDFELTKTTAKEVALLRTYCIEASISNITTATRCPTQGEPYLKEEQDQQYICRRDVVDRGWGNGCGLFGKGGVVTCAKFLCSGKITGNLVQIENLEYTVVVTVHNGDTHAVGNDTSNHGVTATITPRSPSVEVKLPDYGELTLDCEPRSGIDFNEMILMKMKKKTWLVHKQWFLDLPLPWTAGADTSEVHWNYKERMVTFKVPHAKRQDVTVLGSQEGAMHSALAGATEVDSGDGNHMFAGHLKCKVRMEKLRIKGMSYTMCSGKFSIDKEMAETQHGTTVVKVKYEGAGAPCKVPIEIRDVNKEKVVGRIISSTPFAENTNSVTNIELEPPFGDSYIVIGVGDSALTLHWFRKGSSIGKMFESTYRGAKRMAILGETAWDFGSVGGLFTSLGKAVHQVFGSVYTTMFGGVSWMIRILIGFLVLWIGTNSRNTSMAMTCIAVGGITLFLGFTVQADMGCVVSWNGKELKCGSGIFVVDNVHTWTEQYKFQPESPARLASAILNAHKDGVCGIRSTSRLENVMWKQITNELNYVLWEGGHDLTVVAGDVKGVLTKGKRALTPPVNDLKYSWKTWGKAKIFTPEARNSTFLIDGPDTSECPNERRAWNFFEVEDYGFGMFTTNIWMKFREGSSEVCDHRLMSAAIKDQKAVHADMGYWIESSKNQTWQIEKASLIEVKTCLWPKTHTLWSNGVLESQMLIPRSYAGPFSQHNYRQGYATQTAGPWHLGKLEIDFGECPGTTVTIQEDCDHRGPSLRTTTASGKLVTQWCCRSCTMPPLRFLGEDGCWYGMEIRPLSEKEENMVKSQVTAGQGTSETFSMGLLCLTLFVEECLRRRVTRKHMILVVVITFCAIILGGLTWMDLLRALIMLGDTMSGRIGGQIHLAIMAVFKMSPGYVLGVFLRKLTSRETALMVIGMAMTTVFSIPHDLMELIDGISLGLILLKIVTHFDNTQVGTLALSLTFIRSTTPLVMAWRTIMAVFFVVTLIPLCRTSCLQKQSHWVEITALILGAQALPVYLMTLMKGASRRSWPLNEGIMAVGLVSLLGSALLKNDVPLAGPMVAGGLLLAAYVMSGSSADLSLEKAANVQWDEMADITGSSPIIEVKQDEDGSFSIRDVEETNMITLLVKLALITVSGLYPLAIPVTMALWYVWQVKTQRSGALWDVPSPAATQKATLSEGVYRIMQRGLFGKTQVGVGIHMEGVFHTMWHVTRGSVICHETGRLEPSWADVRNDMISYGGGWRLGDKWDKEEDVQVLAIEPGKNPKHVQTKPGLFKTLTGEIGAVTLDFKPGTSGSPIINKKGKVIGLYGNGVVTKSGDYVSAITQAERIGEPDYEVDEDIFRKKRLTIMDLHPGAGKTKRILPSIVREALKRRLRTLILAPTRVVAAEMEEALRGLPIRYQTPAVKSEHTGREIVDLMCHATFTTRLLSSTRVPNYNLIVMDEAHFTDPCSVAARGYISTRVEMGEAAAIFMTATPPGSIDPFPQSNSPIEDIEREIPERSWNTGFDWITDYQGKTVWFVPSIKAGNDIANCLRKSGKRVIQLSRKTFDTEYPKTKLTDWDFVVTTDISEMGANFRAGRVIDPRRCLKPVILTDGPERVILAGPIPVTPASAAQRRGRIGRNPAQEDDQYVFSGDPLKNDEDHAHWTEAKMLLDNIYTPEGIIPTLFGPEREKTQAIDGEFRLRGEQRKTFVELMRRGDLPVWLSYKVASAGISYKDREWCFTGERNNQILEENMEVEIWTREGEKKKLRPKWLDARVYADPMALKDFKEFASGRKSITLDILTEIATLPTYLSSKAKLALDNIVMLHTTEKGGRAYQHALNELPESLETLMLVALLGAMTAGIFLFFMQGKGIGKLSMGLIAIAVASGLLWVAEIQPQWIAASIILEFFLMVLLIPEPEKQRTPQDNQLIYVILTILTIIGLIAANEMGLIEKTKTDFGFYQVKTETTILDVDLRPASAWTLYAVATTILTPMLRHTIENTSANLSLAAIANQAAVLMGLGKGWPLHRMDLGVPLLAMGCYSQVNPTTLTASLVMLLVHYAIIGPGLQAKATREAQKRTAAGIMKNPTVDGITVIDLEPISYDPKFEKQLGQVMLLVLCVGQLLLMRTTWALCEVLTLATGPVMTLWEGNPGRFWNTTIAVSTANIFRGSYLAGAGLAFSLIKNAQTPRRGTGTTGETLGEKWKRQLNSLDRKEFEEYKRSGILEVDRTEAKSALRDGSKIKYAVSRGSSKIRWIVERGMIKPKGKVVDLGCGRGGWSYYMATLKNVTEVKGYTKGGPGHEEPIPMATYGWNLVKLHSGVDVFYKPTEQVDTLLCDIGESSSNPTIEEGRTLRVLKMVEPWLSSKPEFCIKVLNPYMPTVIEELEKLQRRHGGSLVRCPLSRNSTHEMYWVSGASGNIVSSVNTISKMLLNRFTTRHRKPTYEKDVDLGAGTRSVSTETEKPDMTIIGRRLQRLREEHKETWHYDQENPYRTWAYHGSYEAPSTGSASSMVNGVVKLLTKPWDVIPMVTQLAMTDTTPFGQQRVFKEKVDTRTPQPKPGTRMIMTTTANWLWALLGKKKSPRLCTREEFISKVRSNAAIGAVFQEEQGWTSASEAVNDSRFWELVDKERALHQEGKCESCVYNMMGKREKKLGEFGRAKGSRAIWYMWLGARFLEFEALGFLNEDHWFSRENSWSGVEGEGLHRLGYILEDIDKKDGDLIYADDTAGWDTRITEDDLLNEELITEQMAPHHKTLAKAIFKLTYQNKVVKVLRPTPKGAVMDIISRKDQRGSGQVGTYGLNTFTNMEVQLIRQMEAEGVITQDDMQNPKGLKERVEKWLKECGVDRLKRMAISGDDCVVKPLDERFSTSLLFLNDMGKVRKDIPQWEPSKGWKNWQEVPFCSHHFHKIFMKDGRSLVVPCRNQDELIGRARISQGAGWSLRETACLGKAYAQMWSLMYFHRRDLRLASMAICSAVPTEWFPTSRTTWSIHAHHQWMTTEDMLKVWNRVWIEDNPNMTDKTPVHSWEDIPYLGKREDLWCGSLIGLSSRATWAKNIHTAITQVRNLIGKEEYVDYMPAMKRYSAPFESEGVL

SEQ ID NO: 5220 - protein, 3288 aa, Artificial Sequence
  derived and/or modified protein sequence (wt) from DENV-4__KC762695__SS-prME
STMTLLCLIPTAMAFHLSTRDGEPLMIVAKHERGRPLLFKTTEGINKCTLIAMDLGEMCEDTVTYKCPLLVNTEPEDIDSWCNLTSTWVMYGTCTQSGERRREKRSVALTPHSGMGLETRAETWMSSEGAWKHAQRVESWILRNPGFALLAGFMAYMIGQTGIQRTVFFVLMMLVAPSYGMRCVGVGNRDFVEGVSGGAWVDLVLEHGGCVTTMAQGKPTLDFELTKTTAKEVALLRTYCIEASISNITTATRCPTQGEPYLKEEQDQQYICRRDVVDRGWGNGCGLFGKGGVVTCAKFLCSGKITGNLVQIENLEYTVVVTVHNGDTHAVGNDTSNHGVTATITPRSPSVEVKLPDYGELTLDCEPRSGIDFNEMILMKMKKKTWLVHKQWFLDLPLPWTAGADTSEVHWNYKERMVTFKVPHAKRQDVTVLGSQEGAMHSALAGATEVDSGNGNHMFAGHLKCKVRMEKLRIKGMSYTMCSGKFSIDKEMAETQHGTTVVKVKYEGAGAPCKVPIEIRDVNKEKVVGRIISSTPFAENTNSVTNIELEPPFGDSYIVIGVGDSALTLHWFRKGSSIGKMFESTYRGAKRMAILGETAWDFGSVGGLFTSLGKAIHQVFGSVYTTMFGGVSWMIRILIGLLVLWIGTNSRNTSMAMTCIAVGGITLFLGFTVQADMGCVVSWNGKELKCGSGIFVVDNVHTWTEQYKFQPESPARLASAILNAHKDGVCGIRSTTRLENVMWKQITNELNYVLWEGGHDLTVVAGDVKGVLTKGKRALTPPVNDLKYSWKTWGKAKIFTPEARNSTFLIDGPDTSECPNERRAWNFLEVEDYGFGMFSTNIWMKFREGSSEVCDHRLMSAAIKDQKAVHADMGYWIESSKNQTWQIEKASLIEVKTCLWPKTHTLWSNGVLESQMLIPRSYAGPFSQHNYRQGYATQIAGPWHLGKLEIDFGECPGTTVTIQEDCDHRGPSLRTTTASGKLVTQWCCRSCTMPPLRFLGEDGCWYGMEIRPLSEKEENMVKSQVTAGQGTSETFSMGLLCLTLFVEECLRRRVTRKHMILVVTITFCAIILGGLTWMDLLRALIMLGDTMSGRIGGQIHLAIMAVFKMSPGYVLGVFLRKLTSRETALMVIGMAMTTVFSIPHDLMELIDGISLGLILLKIVTHFDDTQVGTLALSLTFIRSTTPLVMAWRTIMAVFFVVTLIPLCRTSCLQKQSHWVEITALILGAQALPVYLMTLMKGASRRSWPLNEGIMAVGLVSLLGSALLKNDVPLAGPMVAGGLLLAAYVMSGSSADLSLEKAANVQWDEMADITGSSPIIEVKQDEDGSFSIRDVEETNMITLLVKLALITVSGLYPLAIPVTMALWYIWQVKTQRSGALWDVPSPVATQKATLSEGVYRIMQRGLFGKTQVGVGIHMEGVFHTMWHVTRGSVICHETGRLEPSWADVRNDMISYGGGWRLGDKWDKEEDVQVLAIEPGKNPKHVQTKPGLFKTLTGEIGAVTLDFKPGTSGSPIINKKGKVIGLYGNGVVTKSGDYVSAITQAERIGEPDYEVDEDIFRKKRLTIMDLHPGAGKTKRILPSIVREALKRRLRTLILAPTRVVAAEMEEALRGLPIRYQTPAVKSEHTGREIVDLMCHATFTTRLLSSTRVPNYNLIVMDEAHFTDPCSVAARGYISTRVEMGEAAAIFMTATPPGSTDPFPQSNSPIEDIEREIPERSWNTGFDWITDYQGKTVWFVPSIKAGNDIANCLRKSGKRVIQLSRKTFDTEYPKTKLTDWDFVVTTDISEMGANFRAGRVIDPRRCLKPVILTDGPERVILAGPIPVTPASAAQRRGRIGRNPAQEDDQYVFSGDPLKNDEDHAHWTEAKMLLDNIYTPEGIIPTLFGPEREKTQAIDGEFRLRGEQRKTFVELMRRGDLPVWLSYKVASAGISYKDREWCFTGERNNQILEENMEVEIWTREGEKKKLRPKWLDARVYADPMALKDFKEFASGRKSITLDILTEIATLPTYLSSKAKLALDNIVMLHTTEKGGRAYQHALNELPESLETLMLVALLGAMTAGIFLFFMQGKGIGKLSIGLIAIAVASGLLWVAEIQPQWIAASIILEFFLMVLLIPEPEKQRTPQDNQLIYVILTILTIIGLIAANEMGLIEKTKTDFGFYQVKTETTILDVDLRPASAWTLYAVATTILTPMLRHTIENTSANLSLAAIANQAAVLMGLGKGWPLHRMDLGVPLLAMGCYSQVNPTTLTASLVMLLVHYAIIGPGLQAKATREAQKRTAAGIMKNPTVDGITVIDLEPISYDPKFEKQLGQVMLLVLCVGQLLLMRTTWALCEVLTLATGPIMTLWEGNPGRFWNTTIAVSTANIFRGSYLAGAGLAFSLIKNAQTPRRGTGTTGETLGEKWKRQLNSLDRKEFEEYKRSGILEVDRTEAKSALRDGSKIKHAVSRGSSKIRWIVERGMIKPKGKVVDLGCGRGGWSYYMATLKNVTEVKGYTKGGPGHEEPIPMATYGWNLVKLHSGVDVFYKPTEQVDTLLCDIGESSSNPTIEEGRTLRVLKMVEPWLSSKPEFCIKVLNPYMPTVIEELEKLQRRHGGSLVRCPLSRNSTHEMYWVSGASGNIVSSVNTISKMLLNRFTTRHRKPTYEKDVDLGAGTRSVSTETEKPDMTIIGRRLQRLREEHKETWHYDQENPYRTWAYHGSYEAPSTGSASSMVNGVVKLLTKPWDVIPMVTQLAMTDTTPFGQQRVFKEKVDTRTPQPKPGTRMIMTTTANWLWALLGKKKSPRLCTREEFISKVRSNAAIGAVFQEEQGWTSASEAVNDSRFWELVDKERALHQEGKCESCVYNMMGKREKKLGEFGRAKGSRAIWYMWLGARFLEFEALGFLNEDHWFSRENSWSGVEGEGLHRLGYILEDIDKKDGDLIYADDTAGWDTRITEDDLLNEELITEQMAPHHKTLAKAIFKLTYQNKVVKVLRPTPKGAVMDIISRKDQRGSGQVGTYGLNTFTNMEVQLIRQMEAEGVITQDDMQNPKGLEERVEKWLKECGVDRLKRMAISGDDCVVKPLDERFSTSLLFLNDMGKVRKDIPQWEPSKGWKNWQEVPFCSHHFHKIFMKDGRSLVVPCRNQDELIGRARISQGAGWSLRETACLGKAYAQMWSLMYFHRRDLRLASMAICSAVPTEWFPISRTTWSIHAHHQWMTTEDMLKVWNRVWIEDNPNMTDKTPIHSWEDIPYLGKREDLWCGSLIGLSSRATWAKNIHTAISQVRNLIGKEEYVDYMPVMKRYSAPSESEGVL

SEQ ID NO: 5221 - protein, 3288 aa, Artificial Sequence
  derived and/or modified protein sequence (wt) from DENV-4__KC762696__SS-prME
STMTLLCLIPTVMAFHLSTRDGEPLMIVAKHERGRPLLFKTTEGINKCTLIAMDLGEMCEDTVTYKCPLLVNTEPEDIDCWCNLTSTWVMYGTCTQSGERRREKRSVALTPHSGMGLETRAETWMSSEGAWKHAQRVESWILRNPGFALLAGFMAYMIGQTGIQRTVFFVLMMLVAPSYGMRCVGVGNRDFVEGVSGGAWVDLVLEHGGCVTTMAQGKPTLDFELTKTTAKEVALLRTYCIEASISNITTATRCPTQGEPYLKEEQDQQYICRRDVVDRGWGNGCGLFGKGGVVTCAKFLCSGKITGNLVQIENLEYTVVVTVHNGDTHAVGNDTSNHGVTATITPRSPSVEVKLPDYGELTLDCEPRSGIDFNEMILMKMKKKTWLVHKQWFLDLPLPWTAGADTSEVHWNYKERMVTFKVPHAKRQDVTVLGSQEGAMHSALAGATEVDSGDGNHMFAGHLKCKVRMEKLRIKGMSYTMCSGKFSIDKEMAETQHGTTVVKVKYEGAGAPCKVPIEIRDVNKEKVVGRIISSTPFAENTNSVTNIELEPPFGDSYIVIGVGDSALTLHWFRKGSSIGKMFESTYRGAKRMAILGETAWDFGSVGGLFTSLGKAVHQVFGSVYTTMFGGVSWMIRILIGFLVLWIGTNSRNTSMAMTCIAVGGITLFLGFTVQADMGCVVSWNGKELKCGSGIFVVDNVHTWTEQYKFQPESPARLASAILNAHKDGVCGIRSTTRLENVMWKQITNELNYVLWEGGHDLTVVAGDVKGVLTKGKRALTPPVNDLKYSWKTWGKAKIFTPEARNSTFLIDGPDTSECPNERRAWNFFEVEDYGFGMFTTNIWMKFREGSSEVCDHRLMSAAIKDQKAVHADMGYWIESSKNQTWQIEKASLIEVKTCLWPKTHTLWSNGVLESQMLIPRSYAGPFSQHNYRQGYATQTAGPWHLGKLEIDFGECPGTTVTIQEDCDHRGPSLRTTTASGKLVTQWCCRSCTMPPLRFLGEDGCWYGMEIRPLSEKEENMVKSQVTAGQGTSETFSMGLLCLTLFVEECLRRRVTRKHMILVVVITFCAIILGGLTWMDLLRALIMLGDTMSGRIGGQIHLAIMAVFKMSPGYVLGVFLRKLTSRETALMVIGMAMTTVFSIPHDLMELIDGISLGLIILKIVTHFDNTQVGTLALSLTFIRSTTPLVMAWRTIMAVFFVVTLIPLCRTSCLQKQSHWVEITALILGAQALPVYLMTLMKGASRRSWPLNEGIMAVGLVSLLGSALLKNDVPLAGPMVAGGLLLAAYVMSGSSADLSLEKAANVQWDEMADITGSSPIIEVKQDEDGSFSIRDVEETNMITLLVKLALITVSGLYPLAIPVTMALWYVWQVKTQRSGALWDVPSPAATQKATLSEGVYRIMQRGLFGKTQVGVGIHMEGVFHTMWHVTRGSVICHETGRLEPSWADVRNDMISYGGGWRLGDKWDKEEDVQVLAIEPGKNPKHVQTKPGLFKTLTGEIGAVTLDFKPGTSGSPIINKKGKVIGLYGNGVVTKSGDYVSAITQAERIGEPDYEVDEDIFRKKRLTIMDLHPGAGKTKRILPSIVREALKRRLRTLILAPTRVVAAEMEEALRGLPIRYQTPAVKSEHTGREIVDLMCHATFTTRLLSSTRVPNYNLIVMDEAHFTDPCSVAARGYISTRVEMGEAAAIFMTATPPGSIDPFPQSNSPIEDIEREIPERSWNTGFDWITDYQGKTVWFVPSIKAGNDIANCLRKSGKRVIQLSRKTFDTEYPKTKLTDWDFVVTTDISEMGANFRAGRVIDPRRCLKPVILTDGPERVILAGPIPVTPASAAQRRGRIGRNPAQEDDQYVFSGDPLKNDEDHAHWTEAKMLLDNIYTPEGIIPTLFGPEREKTQAIDGEFRLRGEQRKTFVELMRRGDLPVWLSYKVASAGISYKDREWCFTGERNNQILEENMEVEIWTREGEKKKLRPKWLDARVYADPMALKDFKEFASGRKSITLDILTEIATLPTYLSSKAKLALDNIVMLHTTEKGGRAYQHALNELPESLETLMLVALLGAMTAGIFLFFMQGKGIGKLSMGLIAIAVASGLLWVAEIQPQWIAASIILEFFLMVLLIPEPEKQRTPQDNQLIYVILTILTIIGLIAANEMGLIEKTKTDFGFYQVKTETTILDVDLRPASAWTLYAVATTILTPMLRHTIENTSANLSLAAIANQAAVLMGLGKGWPLHRMDLGVPLLAMGCYSQVNPTTLTASLVMLLVHYAIIGPGLQAKATREAQKRTAAGIMKNPTVDGITVIDLEPISYDPKFEKQLGQVMLLVLCVGQLLLMRTTWALCEVLTLATGPVMTLWEGNPGRFWNTTIAVSTANIFRGSYLAGAGLAFSLIKNAQTPRRGTGTTGETLGEKWKRQLNSLDRKEFEEYKRSGILEVDRTEAKSALRDGSKIKYAVSRGSSKIRWIVERGMIKPKGKVVDLGCGRGGWSYYMATLKNVTEVKGYTKGGPGHEEPIPMATYGWNLVKLHSGVDVFYKPTEQVDTLLCDIGESSSNPTIEEGRTLRVLKMVEPWLSSKPEFCIKVLNPYMPTVIEELEKLQRRHGGSLVRCPLSRNSTHEMYWVSGASGNIVSSVNTISKMLLNRFTTRHRKPTYEKDVDLGAGTRSVSTETEKPDMTIIGRRLQRLREEHKETWHYDQENPYRTWAYHGSYEAPSTGSASSMVNGVVKLLTKPWDVIPMVTQLAMTDTTPFGQQRVFKEKVDTRTPQPKPGTRMIMTTTANWLWALLGKKKSPRLCTREEFISKVRSNAAIGAVFQEEQGWTSASEAVNDSRFWELVDKERALHQEGKCESCVYNMMGKREKKLGEFGRAKGSRAIWYMWLGARFLEFEALGFLNEDHWFSRENSWSGVEGEGLHRLGYILEDIDKKDGDLIYADDTAGWDTRITEDDLLNEELITEQMAPHHKTLAKAIFKLTYQNKVVKVLRPTPKGAVMDIISRKDQRGSGQVGTYGLNTFTNMEVQLIRQMEAEGVITQDDMQNPKGLKERVEKWLKECGVDRLKRMAISGDDCVVKPLDERFSTSLLFLNDMGKVRKDIPQWEPSKGWKNWQEVPFCSHHFHKIFMKDGRSLVVPCRNPDELIGRARISQGAGWSLRETACLGKAYAQMWSLMYFHRRDLRLASMAICSAVPTEWFPTSRTTWSIHAHHQWMTTEDMLKVWNRVWIEDNPNMTDKTPVHSWEDIPYLGKREDLWCGSLIGLSSRATWAKNIHTAITQVRNLIGKEEYVDYMPAMKRYSAPFESEGVL

SEQ ID NO: 5222 - protein, 3288 aa, Artificial Sequence
  derived and/or modified protein sequence (wt) from DENV-4__KC762697__SS-prME
STMTLLCLIPTAMAFHLSTRDGEPLMIVAKHERGRPLLFKTTEGINKCTLIAMDLGEMCEDTVTYKCPLLVNTEPEDIDCWCNLTSTWVMYGTCTQSGERRREKRSVALTPHSGMGLETRAETWMSSEGAWKHAQRVESWILRNPGFALLAGFMAYMIGQTGIQRTVFFVLMMLVAPSYGMRCVGVGNRDFVEGVSGGAWVDLVLEHGGCVTTMAQGKPTLDFELTKTTAKEVALLRTYCIEASISNITTATRCPTQGEPYLKEEQDQQYICRRDVVDRGWGNGCGLFGKGGVVTCAKFLCSGKITGNLVQIENLEYTVVVTVHNGDTHAVGNDTSNHGVTATITPRSPSVEVKLPDYGELTLDCEPRSGIDFNEMILMKMKKKTWLVHKQWFLDLPLPWTAGADTSEVHWNYKERMVTFKVPHAKRQDVTVLGSQEGAMHSALAGATEVDSGDGNHMFAGHLKCKVRMEKLRIKGMSYTMCSGKFSIDKEMAETQHGTTVVKVKYEGAGAPCKVPIEIRDVNKEKVVGRIISSTPFAENTNSVTNIELEPPFGDSYIVIGVGDSALTLHWFRKGSSIGKMFESTYRGAKRMAILGETAWDFGSVGGLFTSLGKAVHQVFGSVYTTMFGGVSWMIRILIGLLVLWIGTNSRNTSMAMTCIAVGGITLFLGFTVQADMGCVVSWNGKELKCGSGIFVVDNVHTWTEQYKFQPESPARLASAILNAHKDGVCGIRSTTRLENVMWKQITNELNYVLWEGGHDLTVVAGDVKGVLTKGKRVLTPPVNDLKYSWKTWGKAKIFTPEARNSTFLIDGPDTSECPNERRAWNFFEVEDYGFGMFSTNIWMKFREGSSEVCDHRLMSAAIKDQKAVHADMGYWIESSKNQTWQIEKASLIEVKTCLWPKTHTLWSNGVLESQMLIPRSYAGPFSQHNYRQGYATQIAGPWHLGKLEIDFGECPGTTVTIQEDCDHRGPSLRTTTASGKLVTQWCCRSCTMPPLRFLGEDGCWYGMEIRPLSEKEENMVKSQVTAGQGTSETFSMGLLCLTLFVEECLRRRVTRKHMILVVAITFCAIILGGLTWMDLLRALIMLGDTMSGRIGGQIHLAIMAVFKMSPGYVLGVFLRKLTSRETALMVIGMAMTTVFSIPHDLMELIDGISLGLILLKIVTHFDDTQVGTLALSLTFIRSTTPLVMAWRTIMAVFFMVTLIPLCRTSCLQKQSHWVEITALILGAQALPVYLMTLMKGASRRSWPLNEGIMAVGLVSLLGSALLKNDVPLAGPMVAGGLLLAAYVMSGSSADLSLEKAANVQWDEMADITGSSPIIEVKQDEDGSFSIRDVEETNMITLLVKLALITVSGLYPLAIPVTMALWYIWQVKTQRSGALWDVPSPAATQKATLSEGVYRIMQRGLFGKTQVGVGIHMEGVFHTMWHVTRGSVICHETGRLEPSWADVRNDMISYGGGWRLGDKWDKEEDVQVLAIEPGKNPKHVQTKPGLFKTLTGEIGAVTLDFKPGTSGSPIINKKGKVIGLYGNGVVTKSGDYVSAITQAERIGEPDYEVDEDIFRKKRLTIMDLHPGAGKTKRILPSIVREALKRRLRTLILAPTRVVAAEMEEALRGLPIRYQTPAVKAEHTGREIVDLMCHATFTTRLLSSTRVPNYNLIVMDEAHFTDPCSVAARGYISTRVEMGEAAAIFMTATPPGSTDPFPQSNSPIEDIEREIPERSWNTGFDWITDYQGKTVWFVPSIKAGNDIANCLRKSGKRVIQLSRKTFDTEYPKTKLTDWDFVVTTDISEMGANFRAGRVIDPRRCLKPVILTDGPERVILAGPIPVTPASAAQRRGRIGRNPAQEDDQYVFSGDPLKNDEDHAHWTEAKMLLDNIYTPEGIIPTLFGPEREKTQAIDGEFRLRGEQRKTFVELMRRGDLPVWLSYKVASAGISYKDREWCFTGERNNQILEENMEVEIWTREGEKKKLRPKWLDARVYADPMALKDFKEFASGRKSITLDILTEIATLPTYLSSKAKLALDNIVMLHTTEKGGRAYQHALNELPESLETLMLVALLGAMTAGIFLFFMQGKGIGKLSMGLIAIAVASGLLWVAEIQPQWIAASIILEFFLMVLLIPEPEKQRTPQDNQLIYVILTILTIIGLIAANEMGLIEKTKTDFGFYQAKTETTILDVDLRPASAWTLYAVATTILTPMLRHTIENTSANLSLAAIANQAAVLMGLGKGWPLHRMDLGVPLLAMGCYSQVNPTTLTASLVMLLVHYAIIGPGLQAKATREAQKRTAAGIMKNPTVDGITVIDLEPISYDPKFEKQLGQVMLLVLCVGQLLLMRTTWALCEVLTLATGPIMTLWEGNPGRFWNTTIAVSTANIFRGSYLAGAGLAFSLIKNAQTPRRGTGTTGETLGEKWKRQLNSLDRKEFEEYKRSGILEVDRTEAKSALRDGSKIKYAVSRGSSKIRWIVERGMVKPKGKVVDLGCGRGGWSYYMATLKNVTEVKGYTKGGPGHEEPIPMATYGWNLVKLHSGVDVFYKPTEQVDTLLCDIGESSSNPTIEEGRTLRVLKMVEPWLSSKPEFCIKVLNPYMPTVIEELEKLQRRHGGSLVRCPLSRNSTHEMYWVSGASGNIVSSVNTISKMLLNRFTTRHRKPTYEKDVDLGAGTRSVSTETEKPDMTIIGRRLQRLREEHKETWHYDQENPYRTWAYHGSYEAPSTGSASSMVNGVVKLLTKPWDVIPMVTQLAMTDTTPFGQQRVFKEKVDTRTPQPKPGTRMIMTTTANWLWALLGKKKSPRLCTREEFISKVRSNAAIGAVFQEEQGWTSASEAVNDSRFWELVDKERALHQEGKCESCVYNMMGKREKKLGEFGRAKGSRAIWYMWLGARFLEFEALGFLNEDHWFSRENSWSGVEGEGLHRLGYILEDIDKKDGDLIYADDTAGWDTRITEDDLLNEELITEQMAPHHKTLAKAIFKLTYQNKVVKVLRPTPKGAVMDIISRKDQRGSGQVGTYGLNTFTNMEVQLIRQMEAEGVITQDDMQNPKGLEERVEKWLKECGVDRLKRMAISGDDCVVKPLDERFSTSLLFLNDMGKVRKDIPQWEPSKGWKNWQEVPFCSHHFHKIFMKDGRSLVVPCRNQDELIGRARISQGAGWSLRETACLGKAYAQMWSLMYFHRRDLRLASMAICSAVPTEWFPTSRTTWSIHAHHQWMTTEDMLKVWNRVWIEDNPNMTDKTPIHSWEDIPYLGKREDLWCGSLIGLSSRATWAKNIHTAITQVRNLIGKEEYVDYMPVMKRYSAPSESEGVL

SEQ ID NO: 5223 - protein, 3288 aa, Artificial Sequence
  derived and/or modified protein sequence (wt) from DENV-4__KC762698__SS-prME
STMTLLCLIPTVMAFHLSTRDGEPLMIVAKHERGRPLLFKTTEGINKCTLIAMDLGEMCEDTVTYKCPLLVNTEPEDIVCWCNLTSTWVMYGTCTQSGERRREKRSVALTPHSGMGLETRAETWMSSEGAWKHAQRVESWILRNPGFALLAGFMAYMIGQTGIQRTVFFVLMMLVAPSYGMRCVGVGNRDFVEGVSGGAWVDLVLEHGGCVTTMAQGKPTLDFELTKTTAKEVALLRTYCIEASISNITTATRCPTQGEPYLKEEQDQQYICRRDVVDRGWGNGCGLFGKGGVVTCAKFLCSGKITGNLVQIENLEYTVVVTVHNGDTHAVGNDTSNHGVTATITPRSPSVEVKLPDYGELTLDCEPRSGIDFNEMILMKMKKKTWLVHKQWFLDLPLPWTAGADTSEVHWNYKERMVTFKVPHAKRQDVTVLGSQEGAMHSALAGATEVDSGDGNHMFAGHLKCKVRMEKLRIKGMSYTMCSGKFSIDKEMAETQHGTTVVKVKYEGAGAPCKVPIEIRDVNKEKVVGRIISSTPFAENTNSVTNIELEPPFGDSYIVIGAGDSALTLHWFRKGSSIGKMFESTYRGAKRMAILGETAWDFGSVGGLFTSLGKAVHQVFGSVYTTMFGGVSWMIRILIGFLVLWIGTNSRNTSMAMTCIAVGGITLFLGFTVQADMGCVVSWNGKELKCGSGIFVVDNVHTWTEQYKFQPESPARLASAILNAHKDGVCGIRSTTRLENVMWKQITNELNYVLWEGGHDLTVVAGDVKGVLTKGKRALTPPVNDLKYSWKTWGKAKIFTPEARNSTFLIDGPDTSECPNERRAWNFFEVEDYGFGMFTTNIWMKFREGSSEVCDHRLMSAAIKDQKAVHADMGYWIESSKNQTWQIEKASLIEVKTCLWPKTHTLWSNGVLESQMLIPRSYAGPFSQHNYRQGYATQTAGPWHLGKLEIDFGECPGTTVTIQEDCDHRGPSLRTTTASGKLVTQWCCRSCTMPPLRFLGEDGCWYGMEIRPLSEKEENMVKSQVTAGQGTSETFSMGLLCLTLFVEECLRRRVTRKHMILVVVITFCAIILGGLTWMDLLRALIMLGDTMSGRIGGQIHLAIMAVFKMSPGYVLGVFLRKLTSRETALMVIGMAMTTVFSIPHDLMELIDGISLGLILLKIVTHFDNTQVGTLALSLTFIRSTTPLVMAWRTIMAVFFVVTLIPLCRTSCLQKQSHWVEITALILGAQALPVYLMTLMKGASRRSWPLNEGIMAVGLVSLLGSALLKNDVPLAGPMVAGGLLLAAYVMSGSSADLSLEKAANVQWDEMADITGSSPIIEVKQDEDGSFSIRDVEETNMITLLVKLALITVSGLYPLAIPVTMALWYVWQVKTQRSGALWDVPSPAATQKATLSEGVYRIMQRGLFGKTQVGVGIHMEGVFHTMWHVTRGSVICHETGRLEPSWADVRNDMISYGGGWRLGDKWDKEEDVQVLAIEPGKNPKHVQTKPGLFKTLTGEIGAVTLDFKPGTSGSPIINKKGKVIGLYGNGVVTKSGDYVSAITQAERIGEPDYEVDEDIFRKKRLTIMDLHPGAGKTKRILPSIVREALKRRLRTLILAPTRVVAAEMEEALRGLPIRYQTPAVKSEHTGREIVDLMCHATFTTRLLSSTRVPNYNLIVMDEAHFTDPCSVAARGYISTRVEMGEAAAIFMTATPPGSIDPFPQSNSPIEDIEREIPERSWNTGFDWITDYQGKTVWFVPSIKAGNDIANCLRKSGKKVIQLSRKTFDTEYPKTKLTDWDFVVTTDISEMGANFRAGRVIDPRRCLKPVILTDGPERVILAGPIPVTPASAAQRRGRIGRNPAQEDDQYVFSGDPLKNDEDHAHWTEAKMLLDNIYTPEGIIPTLFGPEREKTQAIDGEFRLRGEQRKTFVELMRRGDLPVWLSYKVASAGISYKDREWCFTGERNNQILEENMEVEIWTREGEKKKLRPKWLDARVYADPMALKDFKEFASGRKSITLDILTEIATLPTYLSSKAKLALDNIVMLHTTEKGGRAYQHALNELPESLETLMLVALLGAMTAGIFLFFMQGKGIGKLSMGLIAIAVASGLLWVAEIQPQWIAASIILEFFLMVLLIPEPEKQRTPQDNQLIYVILTILTIIGLIAANEMGLIEKTKTDFGFYQVKTENTILDVDLRPASAWTLYAVATTILTPMLRHTIENTSANLSLAAIANQAAVLMGLGKGWPLHRMDLGVPLLAMGCYSQVNPTTLTASLVMLLVHYAIIGPGLQAKATREAQKRTAAGIMKNPTVDGITVIDLEPISYDPKFEKQLGQVMLLVLCVGQLLLMRTTWALCEVLTLATGPVMTLWEGNPGRFWNTTIAVSTANIFRGSYLAGAGLAFSLIKNAQTPRRGTGTTGETLGEKWKRQLNSLDRKEFEEYKRSGILEVDRTEAKSALRDGSKIKYAVSRGSSKIRWIVERGMIKPKGKVVDLGCGRGGWSYYMATLKNVTEVKGYTKGGPGHEEPIPMATYGWNLVKLHSGVDVFYKPTEQVDTLLCDIGESSSNPTIEEGRTLRVLKMVEPWLSSKPEFCIKVLNPYMPTVIEELEKLQRRHGGSLVRCPLSRNSTHEMYWVSGASGNIVSSVNTISKMLLNRFTTRHRKPTYEKDVDLGAGTRSVSTEIEKPDMTIIGRRLQRLREEHKETWHYDHENPYRTWAYHGSYEAPSTGSASSMVNGIVKLLTKPWDVIPMVTQLAMTDTTPFGQQRVFKEKVDTRTPQPKPGTRMIMTTTANWLWALLGKKKSPRLCTREEFISKVRSNAAIGAVFQEEQGWTSASEAVNDSRFWELVDKERALHQEGKCESCVYNMMGKREKKLGEFGRAKGSRAIWYMWLGARFLEFEALGFLNEDHWFSRENSWSGVEGEGLHRLGYILEDIDKKDGDLIYADDTAGWDTRITEDDLLNEELITEQMAPHHKTLAKAIFKLTYQNKVVKVLRPTPKGAVMDIISRKDQRGSGQVGTYGLNTFTNMEVQLIRQMEAEGVITQDDMQNPKGLKERVEKWLKECGVDRLERMAISGDDCVVKPLDERFSTSLLFLNDMGKVRKDIPQWEPSKGWKNWQEVPFCSHHFHKIFMKDGRSLVVPCRNQDELIGRARISQGAGWSLRETACLGKAYAQMWLLMYFHRRDLRLASMAICSAVPTEWFPTSRTTWSIHAHHQWMTTEDMLKVWNRVWIEDNPNMTDKTPVHSWEDIPYLGKREDLWCGSLIGLSSRATWAKNIHTAITQVRNLIGKEEYVDYMPAMKRYSAPFESEGVL

SEQ ID NO: 5224 - protein, 3288 aa, Artificial Sequence
  derived and/or modified protein sequence (wt) from DENV-4__KC762699__SS-prME
STMTLLCLIPTVMAFHLSTRDGEPLMIVAKHERGRPLLFKTTEGINKCTLIAMDLGEMCEDTVTYKCPLLVNTEPEDIDCWCNLTSTWVMYGTCTQSGERRREKRSVALTPHSGMGLETRAETWMSSEGAWKHAQRVESWILRNPGFALLAGFMAYMIGQTGIQRTVFFVLMMLVAPSYGMRCVGVGNRDFVEGVSGGAWVDLVLEHGGCVTTMAQGKPTLDFELTKTTAKEVALLRTYCIEASISNITTATRCPTQGEPYLKEEQDQQYICRRDVVDRGWGNGCGLFGKGGVVTCAKFLCSGKITGNLVQIENLEYTVVVTVHNGDTHAVGNDTSNHGVTATITPRSPSVEVKLPDYGELTLDCEPRSGIDFNEMILMKMKKKTWLVHKQWFLDLPLPWTAGADTSEVHWNYKERMVTFKVPHAKRQDVTVLGSQEGAMHSALAGATEVDSGDGNHMFAGHLKCKVRMEKLRIKGMSYTMCSGKFSIDKEMAETQHGTTVVKVKYEGAGAPCKVPIEIRDVNKEKVVGRIISSTPFAENTNSVTNIELEPPFGDSYIVIGVGDSALTLHWFRKGSSIGKMFESTYRGAKRMAILGETAWDFGSVGGLFTSLGKAVHQVFGSVYTTMFGGVSWMIRILIGFLVLWIGTNSRNTSMAMTCIAVGGITLFLGFTVQADMGCVVSWNGKELKCGSGIFVVDNVHTWTEQYKFQPESPARLASAILNAHKDGVCGIRSTTRLENVMWKQITNELNYVLWEGGHDLTVVAGDVKGVLTKGKRALTPPVNDLKYSWKTWGKAKIFTPEARNSTFLIDGPDTSECPNERRAWNFFEVEDYGFGMFTTNIWMKFREGSSEVCDHRLMSAAIKDQKAVHADMGYWIESSKNQTWQIEKASLIEVKTCLWPKTHTLWSNGVLESQMLIPRSYAGPFSQHNYRQGYATQTAGPWHLGKLEIDFGECPGTTVTIQEDCDHRGPSLRTTTASGKLVTQWCCRSCTMPPLRFLGEDGCWYGMEIRPLSEKEENMVKSQVTAGQGTSETFSMGLLCLTLFVEECLRRRVTRKHMILVVVITFCAIILGGLTWMDLLRALIMLGDTMSGRIGGQIHLAIMAVFKMSPGYVLGVFLRKLTSRETALMVIGMAMTTVFSIPHELMELIDGISLGLILLKIVTHFDNTQVGTLALSLTFIRSTTPLVMAWRTIMAVFFVVTLIPLCRTSCLQKQSHWVEITALILGAQALPVYLMTLMKGASRRSWPLNEGIMAVGLVSLLGSALLKNDVPLAGPMVAGGLLLAAYVMSGSSADLSLEKAANVQWDEMADITGSSPIIEVKQDEDGSFSIRDVEETNMITLLVKLALITVSGLYPLAIPVTMALWYVWQVKTQRSGALWDVPSPAATQKATLSEGVYRIMQRGLFGKTQVGVGIHMEGVFHTMWHVTRGSVICHETGRLEPSWADVRNDMISYGGGWRLGDKWDKEEDVQVLAIEPGKNPKHVQTKPGLFKTLTGEIGAVTLDFKPGTSGSPIINKKGKVIGLYGNGVVTKSGDYVSAITQAERIGEPDYEVDEDIFRKKRLTIMDLHPGAGKTKRILPSIVREALKRRLRTLILAPTRVVAAEMEEALRGLPIRYQTPAVKSEHTGREIVDLMCHATFTTRLLSSTRVPNYNLIVMDEAHFTDPCSVAARGYISTRVEMGEAAAIFMTATPPGSIDPFPQSNSPIEDIEREIPERSWNTGFDWITDYQGKTVWFVPSIKAGNDIANCLRKSGKRVIQLSRKTFDTEYPKTKLTDWDFVVTTDISEMGANFRAGRVIDPRRCLKPVILTDGPERVILAGPIPVTPASAAQRRGRIGRNPAQEDDQYVFSGDPLKNDEDHAHWTEAKMLLDNIYTPEGIIPTLFGPEREKTQAIDGEFRLRGEQRKTFVELMRRGDLPVWLSYKVASAGISYKDREWCFTGERNNQILEENMEVEIWTREGEKKKLRPKWLDARVYADPMALKDFKEFASGRKSITLDILTEIATLPTYLSSKAKLALDNIVMLHTTEKGGRAYQHALNELPESLETLMLVALLGAMTAGIFLFFMQGKGIGKLSMGLIAIAVASGLLWVAEIQPQWIAASIILEFFLMVLLIPEPEKQRTPQDNQLIYVILTILTIIGLIAANEMGLIEKTKTDFGFYQVKTETTILDVDLRPASAWTLYAVATTILTPMLRHTIENTSANLSLAAIANQAAVLMGLGKGWPLHRMDLGVPLLAMGCYSQVNPTTLTASLVMLLVHYAIIGPGLQAKATREAQKRTAAGIMKNPTVDGITVIDLEPISYDPKFEKQLGQVMLLVLCVGQLLLMRTTWALCEVLTLATGPVMTLWEGNPGRFWNTTIAVSTANIFRGSYLAGAGLAFSLIKNAQTPRRGTGTTGETLGEKWKRQLNSLDRKEFEEYKRSGILEVDRTEAKSALRDGSKIKYAVSRGSSKIRWIVERGMIKPKGKVVDLGCGRGGWSYYMATLKNVTEVKGYTKGGPGHEEPIPMATYGWNLVKLHSGVDVFYKPTEQVDTLLCDIGESSSNPTIEEGRTLRVLKMVEPWLSSKPEFCIKVLNPYMPTVIEELEKLQRRHGGSLVRCPLSRNSTHEMYWVSGASGNIVSSVNTISKMLLNRFTTRHRKPTYEKDVDLGAGTRSVSTETEKPDMTIIGRRLQRLREEHKETWHYDQENPYRTWAYHGSYEAPSTGSASSMVNGVVKLLTKPWDVIPMVTQLAMTDTTPFGQQRVFKEKVDTRTPQPKPGTRMIMTTTANWLWALLGKKKSPRLCTREEFISKVRSNAAIGAVFQEEQGWTSASEAVNDSRFWELVDKERALHQEGKCESCVYNMMGKREKKLGEFGRAKGSRAIWYMWLGARFLEFEALGFLNEDHWFSRENSWSGVEGEGLHRLGYILEDIDKKDGDLIYADDTAGWDTRITEDDLLNEELITEQMAPHHKTLAKAIFKLTYQNKVVKVLRPTPKGAVMDIISRKDQRGSGQVGTYGLNTFTNMEVQLIRQMEAEGVITQDDMQNPKGLKERVEKWLKECGVDRLKRMAISGDDCVVKPLDERFSTSLLFLNDMGKVRKDIPQWEPSKGWKNWQEVPFCSHHFHKIFMKDGRSLVVPCRNQDELIGRARISQGAGWSLRETACLGKAYAQMWSLMYFHRRDLRLASMAICSAVPTEWFPTSRTTWSIHAHHQWMTTEDMLKVWNRVWIEDNPNMTDKTPVHSWEDIPYLGKREDLWCGSLIGLSSRATWAKNIHTAITQVRNLIGKEEYVDYMPAMKRYSAPFESEGVL

SEQ ID NO: 5225 - protein, 3288 aa, Artificial Sequence
  derived and/or modified protein sequence (wt) from DENV-4__JQ915085__SS-prME
STMTLLCLIPTVMAFHLSTRDGEPLMIVAKHERGRPLLFKTTEGINKCTLIAMDLGEMCEDTVTYKCPLLVNTEPEDIDCWCNLTSTWVMYGTCTQSGERRREKRSVALTPHSGMGLETRAETWMSSEGAWKHAQRVESWILRNPGFALLAGFMAYMIGQTGIQRTVFFVLMMLVAPSYGMRCVGVGNRDFVEGVSGGAWVDLVLEHGGCVTTMAQGKPTLDFELTKTTAKEVALLRTYCIEASISNITTATRCPTQGEPYLKEEQDQQYICRRDVVDRGWGNGCGLFGKGGVVTCAKFLCSGKITGNLVQIENLEYTVVVTVHNGDTHAVGNDTSNHGVTATITPRSPSVEVKLPDYGELTLDCEPRSGIDFNEMILMKMKKKTWLVHKQWFLDLPLPWTAGADTSEVHWNYKERMVTFKVPHAKRQDVTVLGSQEGAMHSALAGATEVDSGDGNHMFAGHLKCKVRMEKLRIKGMSYTMCSGKFSIDKEMAETQHGTTVVKVKYEGAGAPCKVPIEIRDVNKEKVVGRIISSTPFAENTNSVTNIELEPPFGDSYIVIGVGDSALTLHWFRKGSSIGKMFESTYRGAKRMAILGETAWDFGSVGGLFTSLGKAVHQVFGSVYTTMFGGVSWIIRILIGFLVLWIGTNSRNTSMAMTCIAVGGITLFLGFTVQADMGCVVSWNGKELKCGSGIFVVDNVHTWTEQYKFQPESPARLASAILNAHKDGVCGIRSTTRLENVMWKQITNELNYVLWEGGHDLTVVAGDVKGVLTKGKRALTPPVNDLKYSWKTWGKAKIFTPEARNSTFLIDGPDTSECPNERRAWNFFEVEDYGFGMFTTNIWMKFREGSSEVCDHRLMSAAIKDQKAVHADMGYWIESSKNQTWQIEKASLIEVKTCLWPKTHTLWSNGVLESQMLIPRSYAGPFSQHNYRQGYATQTAGPWHLGKLEIDFGECPGTTVTIQEDCDHRGPSLRTTTASGKLVTQWCCRSCTMPPLRFLGEDGCWYGMEIRPLSEKEENMVKSQVTAGQGTSETFSMGLLCLTLFVEECLRRRVTRKHMILVVVITFCAIILGGLTWVDLLRALIMLGDTMSGRIGGQIHLAIMAVFKMSPGYVLGVFLRKLTSRETALMVIGMAMTTVFSIPRDLMELIDGISLGLILLKIVTHFDNTQVGTLALSLTFIRSTTPLVMAWRTIMVVFFVVTLIPLCRTSCLQKQSHWVEITALILGAQALPVYLMTLMKGASRRSWPLNEGIMAVGLVSLLGSALLKNDVPLAGPMVAGGLLLAAYVMSGSSADLSLEKAANVQWDEMADITGSSPIIEVKQDEDGSFSIRDVEETNMITLLVKLALITVSGLYPLAIPVTMALWYIWQVKTQRSGALWDVPSPAAIQKATLSEGVYRIMQRGLFGKTQVGVGIHMEGVFHTMWHVTRGSVICHETGRLEPSWADVRNDMISYGGGWRLGDKWDKEEDVQVLAIEPGKNPKHVQTKPGLFKTLTGEIGAVTLDFKPGTSGSPIINKKGKVIGLYGNGVVTKSGDYVSAITQAERIGEPDYEVDEDIFRKKRLTIMDLHPGAGKTKRILPSIVREALKRRLRTLILAPTRVVAAEMEEALRGLPIRYQTPAVKSEHTGREIVDLMCHATFTTRLLSSTRVPNYNLIVMDEAHFTDPCSVAARGYISTRVEMGEAAAIFMTATPPGSIDPFPQSNSPIEDIEREIPERSWNTGFDWITDYQGKTVWFVPSIKAGNDIANCLRKSGKKVIQLSRKTFDTEYPKTKLTDWDFVVTTDISEMGANFRAGRVIDPRRCLKPVILTDGPERVILAGPIPVTPASAAQRRGRIGRNPAQEDDQYVFSGDPLKNDEDHAHWTEAKMLLDNIYTPEGIIPTLFGPEREKTQAIDGEFRLRGEQRKTFVELMRRGDLPVWLSYKVASAGISYKDREWCFTGERNNQILEENMEVEIWTREGEKKKLRPKWLDARVYADPMALKDFKEFASGRKSITLDILTEIATLPTYLSSKAKLALDNIVMLHTAEKGGRAYQHALNELPESLETLMLVALLGAMTAGIFLFFMQGKGIGKLSMGLIAIAVASGLLWVAEIQPQWIAASIILEFFLMVLLIPEPEKQRTPQDNQLIYVILTILTIIGLIAANEMGLIEKTKTDFGFYQVKTETTILDVDLRPASAWTLYAVATTILTPMLRHTIENTSANLSLAAIANQAAVLMGLGKGWPLHRMDLGVPLLAMGCYSQVNPTTLTASLVMLLVHYAIIGPGLQAKATREAQKRTAAGIMKNPTVDGITVIDLEPISYDPKFEKQLGQVMLLVLCVGQLLLMRTTWALCEVLTLATGPIMTLWEGNPGRFWNTTIAVSTANIFRGSYLAGAGLAFSLIKNAQTPRRGTGTTGETLGEKWKRQLNSLDRKEFEEYKRSGILEVDRTEAKSALRDGSKIKHAVSRGSSKIRWIVERGMIKPKGKVVDLGCGRGGWSYYMATLKNVTEVKGYTKGGPGHEEPIPMATYGWNLVKLHSGVDVFYKPTEQVDTLLCDIGESSSNPTIEEGRTLRVLKMVEPWLSSKPEFCIKVLNPYMPTVIEELEKLQRRHGGSLVRCPLSRNSTHEMYWVSGASGNIVSSVNTISKMLLNRFTTRHRKPTYEKDVDLGAGTRSVSTETEKPDMTIIGRRLQRLREEHKETWHYDQENPYRTWAYHGSYEAPSTGSASSMVNGVVKLLTKPWDVIPMVTQLAMTDTTPFGQQRVFKEKVDTRTPQPKPGTRMIMTTTANWLWALLGKKKSPRLCTREEFISKVRSNAAIGAVFQEEQGWTSASEAVNDSRFWELVDKERALHQEGKCESCVYNMMGKREKKLGEFGRAKGSRAIWYMWLGARFLEFEALGFLNEDHWFSRENSWSGVEGEGLHRLGYILEDIDKKDGDLIYADDTAGWDTRITEDDLLNEELITEQMAPHHKTLAKAIFKLTYQNKVVKVLRPTPKGAVMDIISRKDQRGSGQVGTYGLNTFTNMEVQLIRQMEAEGVITQDDMQNPKGLKERVEKWLKECGVDRLKRMAISGDDCVVKPLDERFSTSLLFLNDMGKVRKDIPQWEPSKGWKNWQEVPFCSHHFHKIFMKDGRSLVVPCRNQDELIGRARISQGAGWSLRETACLGKAYAQMWSLMYFHRRDLRLASMAICSAVPTEWFPTSRTTWSIHAHHQWMTTEDMLKVWNRVWIEDNPNMTDKTPVHSWEDIPYLGKREDLWCGSLIGLSSRATWAKNIHTAITQVRNLIGKEEYVDYMPAMKRYSAPFESEGVL

SEQ ID NO: 5226 - protein, 3288 aa, Artificial Sequence
  derived and/or modified protein sequence (wt) from DENV-4__JQ915088__SS-prME
STMTLLCLIPTVMAFHLSTRDGEPLMIVAKHERGRPLLFKTTEGINKCTLIAMDLGEMCEDTVTYKCPLLVNTEPEDIDCWCNLTSTWVMYGTCTQSGERRREKRSVALTPHSGMGLETRAETWMSSEGAWKHAQRVESWILRNPGFALLAGFMAYMIGQTGIQRIVFFVLMMLVAPSYGMRCVGVGNRDFVEGVSGGAWVDLVLEHGGCVTTMAQGKPTLDFELTKTTAKEVALLRTYCIEASISNITTATRCPTQGEPYLKEEQDQQYICRRDVVDRGWGNGCGLFGKGGVVTCAKFLCSGKITGNLVQIENLEYTVVVTVHNGDTHAVGNDTSNHGVTATITPRSPSVEVKLPDYGELTLDCEPRSGIDFNEMILMKMKKKTWLVHKQWFLDLPLPWTAGADTSEVHWNYKERMVTFKVPHAKRQDVTVLGSQEGAMHSALAGATEVDSGDGNHMFAGHLKCKVRMEKLRIKGMSYTMCSGKFSIDKEMAETQHGTTVVKVKYEGAGAPCKIPIEIRDVNKEKVVGRIISSTPFAENTNSVINIELEPPFGDSYIVIGVGDSALTLHWFRKGSSIGKMFESTYRGAKRMAILGETAWDFGSVGGLFTSLGKAVHQVFGSVYTTMFGGVSWMIRILIGFLVLWIGTNSRNTSMAMTCIAVGGITLFLGFTVQADMGCVVSWNGKELKCGSGIFVVDNVHTWTEQYKFQPESPARLASAILNAHKDGVCGIRSTTRLENVMWKQITNELNYVLWEGGHDLTVVAGDVKGVLTKGKRALTPPVNDLKYSWKTWGKAKISTPEARNSTFLIDGPDTSECPNERRAWNFFEVEDYGFGMFTTNIWMKFREGSSEVCDHRLMSAAIKDQKAVHADMGYWIESSKNQTWQIEKASLIEVKTCLWPKTHTLWSNGVLESQMLIPRSYAGPFSQHNYRQGYATQTAGPWHLGKLEIDFGECPGTTVKIQEDCDHRGPSLRTTTASGKLVTQWCCRSCTMPPLRFLGEDGCWYGMEIRPLSEKEENMVKSQVTAGQGTSETFSMGLLCLTLFVEECLRRRVTRKHMILVVVITFCAIILGGLTWMDLLRALIMLGDTMSGRIGGQIHLAIMTVFKMSPGYVLGVFLRKLTSRETALMVIGMAMTTVFSIPHDLMELIDGISLGLILLKIVTHFDNTQVGTLALSLTFMRSTTPLVMAWRTIMAVFFVITLIPLCRTSCLQKQSHWVEITALILGAQALPVYLMTLMKGASRRSWPLNEGIMAVGLVSLLGSALLKNDVPLAGPMVAGGLLLAAYVMSGSSADLSLEKAANVQWDEMADITGSSPIIEVKQDEDGSFSIRDVEETNMITLLVKLALITVSGLYPLAIPVTMALWYIWQVKTQRSGALWDVPSPAATQKATLSEGVYRIMQRGLFGKTQVGVGIHMEGVFHTMWHVTRGSVICHETGRLEPSWADVRNDMISYGGGWRLGDKWDKEEDVQVLAIEPGKNPRHVQTKPGLFKTLTGEIGAVTLDFKPGTSGSPIINKKGKVIGLYGNGVVTKSGDYVSAITQAERIGEPDYEVDEDIFRKKRLTIMDLHPGAGKTKRILPSIVREALKRRLRTLILAPTRVVAAEMEEALRGLPIRYQTPAVKSEHTGREIVDLMCHATFTTRLLSSTRVPNYNLIVMDEAHFTDPCSVAARGYISTRVEMGEAAAIFMTATPPGSIDPFPQSNSPIEDIEREIPERSWNTGFDWITDYQGKTVWFVPSIKAGNDIANCLRKSGKRVIQLSRKTFDTEYPKTKLTDWDFVVTTDISEMGANFRAGRVIDPRRCLKPVILTDGPERVILAGPIPVTPASAAQRRGRIGRNPAQEDDQYVFSGDPLKNDEDHAHWTEAKMLLDNIYTPEGIIPTLFGPEREKTQAIDGEFRLRGEQRKTFVELMRRGDLPVWLSYKVASAGISYKDREWCFTGERNNQILEENMEVEIWTREGEKKKLRPKWLDARVYADPMALKDFKEFASGRKSTTLDILTEIATLPTYLSSKAKLALDNIVMLHTTEKGGRAYQHALNELPESLETLMLVALLGAMTAGIFLFFMQGKGIGKLSMGLIAMAVASGLLWVAEIQPQWIAASIILEFFLMVLLIPEPEKQRTPQDNQLIYVILTILTIIGLIAANEMGLIEKTKTDFGFYQVKTETTILDVDLRPASAWTLYAVATTILTPMLRHTIENTSANLSLAAIANQAAVLMGLGKGWPLHRMDLGVPLLAMGCYSQVNPTTLTASLVMLLIHYAIIGPGLQAKATREAQKRTAAGIMKNPTVDGITVIDLEPISYDPKFEKQLGQVMLLVLCVGQLLLMRTTWALCEVLTLATGPIMTLWEGNPGRFWNTTIAVSTANIFRGSYLAGAGLAFSLIKNAQTPRRGTGTTGETLGEKWKRQLNSLDRKEFEEYKRSGILEVDRTEAKSALRDGSKIKHAVSRGSSKIRWIVERGMIKPKGKVVDLGCGRGGWSYYMATLKNVTEVKGYTKGGPGHEEPIPMATYGWNLVKLHSGVDVFYKPTEQVDTLLCDIGESSSNPTIEEGRTLRILKMVEPWLSSKPEFCIKVLNPYMPTVIEELEKLQRRHGGSLVRCPLSRNSTHEMYWVSGASGNIVSSVNTISKMLLNRFTTRHRKPTYEKDVDLGAGTRSVSTETEKPDMTIIGRRLQRLQEEHKETWHYDQENPYRTWAYHGSYEAPSTGSASSMVNGVVKLLTKPWDVIPMVTQLAMTDTTPFGQQRVFKEKVDTRTPQPKLGTRMIMTTTANWLWALLGKKKSPRLCTREEFISKVRSNAAIGAVFQEEQGWTSASEAVNDSRFWELVDKERALHQEGKCESCVYNMMGKREKKLGEFGRAKGSRAIWYMWLGARFLEFEALGFLNEDHWFSRENSWSGVEGEGLHRLGYILEDIDKKDGDLIYADDTAGWDTRITEDDLLNEELITEQMAPHHKTLAKAIFKLTYQNKVVKVLRPTPKGAVMDIISRKDQRGSGQVGTYGLNTFTNMEVQLIRQMEAEGVITQDDMQNPKGLKERVEKWLKECGVDRLKRMAISGDDCVVKPLDERFSTSLLFLNDMGKVRKDVPQWEPSKGWKNWQEVPFCSHHFHKIFMKDGRSLVVPCRNQDELIGRARISQGAGWSLRETACLGKAYAQMWSLMYFHRRDLRLASMAICSAVPTEWFPTSRTTWSIHAQHQWMTTEDMLKVWNRVWIEDNPNMTDKTPVHSWEDIPYLGKREDLWCGSLIGLSSRATWAKNIHTAITQVRNLIGKEEYVDYMPVMKRYSSPSESEGVL

SEQ ID NO: 5227 - protein, 3288 aa, Artificial Sequence
  derived and/or modified protein sequence (wt) from DENV-4__JQ915086__SS-prME
STMTLLCLIPTVMAFHLSTRDGEPLMIVAKHERGRPLLFKTTEGINKCTLIAMDLGEMCEDTVTYKCPLLVNTEPEDIDCWCNLTSTWVMYGTCTQSGERRREKRSVALTPHSGMGLETRAETWMSSEGAWKHAQRVESWILRNPGFALLAGFMAYMIGQTGIQRTVFFVLMMLVAPSYGMRCVGVGNRDFVEGVSGGAWVDLVLEHGGCVTTMAQGKPTLDFELTKTTAKEVALLRTYCIEASISNITTATRCPTQGEPYLKEEQDQQYICRRDVVDRGWGNGCGLFGKGGVVTCAKFLCSGKITGNLVQIENLEYTVVVTVHNGDTHAVGNDTSNHGVTATITPRSPSVEVKLPDYGELTLDCEPRSGIDFNEMILMKMKKKTWLVHKQWFLDLPLPWTAGADTSEVHWNYKERMVTFKVPHAKRQDVTVLGSQEGAMHSALAGATEVDSGDGNHMFAGHLKCKVRMEKLRIKGMSYTMCSGKFSIDKEMAETQHGTTVVKVKYEGAGAPCKIPIEIRDVNKEKVVGRIISSTPFAENTNSVINIELEPPFGDSYIVIGVGDSALTLHWFRKGSSIGKMFESTYRGAKRMAILGETAWDFGSVGGLFTSLGKAVHQVFGSVYTTMFGGVSWMIRILIGFLVLWIGTNSRNTSMAMTCIAVGGITLFLGFTVQADMGCVVSWNGKELKCGSGIFVVDNVHTWTEQYKFQPESPARLASAILNAHKDGVCGIRSTTRLENVMWKQITNELNYVLWEGGHDLTVVAGDVKGVLTKGKRVLTPPVNDLKYSWKTWGKAKIFTPEARNSTFLIDGPDTSECPNERRAWNFFEVEDYGFGMFTTNIWMKFREGSSEVCDHRLMSAAIKDQKAVHADMGYWIESSKNQTWQIEKASLIEVKTCLWPKTHTLWSNGVLESQMLIPRSYAGPFSQHNYRQGYATQTAGPWHLGKLEIDFGECPGTTVKIQEDCDHRGPSLRTTTASGKLVTQWCCRSCTMPPLRFLGEDGCWYGMEIRPLSEKEENMVKSQVTAGQGTSETFSMGLLCLTLFVEECLRRRVTRKHMILVVVITFCAIILGGLTWMDLLRALIMLGDTMSGRIGGQIHLAIMTVFKMSPGYVLGVFLRKLTSRETALMVIGMAMTTVFSIPHDLMELIDGISLGLILLKIVTHFDNTQVGTLALSLTFIRSTTPLVMAWRTIMAVFFVITLIPLCRTSCLQKQSHWVEITALILGAQALPVYLMTLMKGASRRSWPLNEGIMAVGLVSLLGSALLKNDVPLAGPMVAGGLLLAAYVMSGSSADLSLEKAANVQWDEMADITGSSPIIEVKQDEDGSFSIRDVEETNMITLLVKLALITVSGLYPLAIPVTMALWYIWQVKTQRSGALWDVPSPAATQKATLSEGVYRIMQRGLFGKTQVGVGIHMEGVFHTMWHVTRGSVICHETGRLEPSWADVRNDMISYGGGWRLGDKWDKEEDVQVLAIEPGKNPRHVQTKPGLFKTLTGEIGAVTLDFKPGTSGSPIINKKGKVIGLYGNGVVTKSGDYVSAITQAERIGEPDYEVDEDIFRKKRLTIMDLHPGAGKTKRILPSIVREALKRRLRTLILAPTRVVAAEMEEALRGLPIRYQTPAVKSEHTGREIVDLMCHATFTTRLLSSTRVPNYNLIVMDEAHFTDPCSVAARGYISTRVEMGEAAAIFMTATPPGSIDPFPQSNSPIEDIEREIPERSWNTGFDWITDYQGKTVWFVPSIKAGNDIANCLRKSGKRVIQLSRKTFDTEYPKTKLTDWDFVVTTDISEMGANFRAGRVIDPRRCLKPVILTDGPERVILAGPIPVTPASAAQRRGRIGRNPAQEDDQYVFSGDPLKNDEDHAHWTEAKMLLDNIYTPEGIIPTLFGPEREKTQAIDGEFRLRGEQRKTFVELMRRGDLPVWLSYKVASAGISYKDREWCFTGERNNQILEENMEVEIWTREGEKKKLRPKWLDARVYADPMALKDFKEFASGRKSTTLDILTEIATLPTYLSSKAKLALDNIVMLHTTEKGGRAYQHALNELPESLETLMLVALLGAMTAGIFLFFMQGKGIGKLSMGLIAIAVASGLLWVAEIQPQWIAASIILEFFLMVLLIPEPEKQRTPQDNQLIYVILTILTIIGLIAANEMGLIEKTKTDFGFYQVKTETTILDVDLRPASAWTLYAVATTILTPMLRHTIENTSANLSLAAIANQAAVLMGLGKGWPLHRMDLGVPLLAMGCYSQVNPTTLTASLVMLLIHYAIIGPGLQAKATREAQKRTAAGIMKNPTVDGITVIDLEPISYDPKFEKQLGQVMLLVLCVGQLLLMRTTWALCEVLTLATGPIMTLWEGNPGRFWNTTIAVSTANIFRGSYLAGAGLAFSLIKNAQTPRRGTGTTGETLGEKWKRQLNSLDRKEFEEYKRSGILEVDRTEAKSALRDGSKIKHAVSRGSSKIRWIVERGMIKPKGKVVDLGCGRGGWSYYMATLKNVTEVKGYTKGGPGHEEPIPMATYGWNLVKLHSGVDVFYKPTEQVDTLLCDIGESSSNPTIEEGRTLRILKMVEPWLSSKPEFCIKVLNPYMPTVIEELEKLQRRHGGSLVRCPLSRNSTHEMYWVSGASGNIVSSVNTISKMLLNRFTTRHRKPTYEKDVDLGAGTRSVSTETEKPDMTIIGRRLQRLQEEHKETWHYDQENPYRTWAYHGSYEAPSTGSASSMVNGVVKLLTKPWDVIPMVTQLAMTDTTPFGQQRVFKEKVDTRTPQPKLGTRMIMTTTANWLWALLGKKKSPRLCTREEFISKVRSNAAIGAVFQEEQGWTSASEAVNDSRFWELVDKERALHQEGKCESCVYNMMGKREKKLGEFGRAKGSRAIWYMWLGARFLEFEALGFLNEDHWFSRENSWSGVEGEGLHRLGYILEDIDKKDGDLIYADDTAGWDTRITEDDLLNEELITEQMAPHHKTLAKAIFKLTYQNKVVKVLRPTPKGAVMDIISRKDQRGSGQVGTYGLNTFTNMEVQLIRQMEAEGVITQDDMQNPKGLKERVEKWLKECGVDRLKRMAISGDDCVVKPLDERFSTSLLFLNDMGKVRKDVPQWEPSKGWKNWQEVPFCSHHFHKIFMKDGRSLVVPCRNQDELIGRARISQGAGWSLRETACLGKAYAQMWSLMYFHRRDLRLASMAICSAVPTEWFPTSRTTWSIHAQHQWMTTEDMLKVWNRVWIEDNPNMTDKTPVHSWEDIPYLGKREDLWCGSLIGLSSRATWAKNIHTAITQVRNLIGKEEYVDYMPVMKRYSAPSESEGVL

SEQ ID NO: 5228 - protein, 3288 aa, Artificial Sequence
  derived and/or modified protein sequence (wt) from DENV-4__JQ915087__SS-prME
STMTLLCLIPTVMAFHLSTRDGEPLMIVAKHERGRPLLFKTTEGINKCTLIAMDLGEMCEDTVTYKCPLLVNTEPEDIDCWCNLTSTWVMYGTCTQSGERRREKRSVALTPHSGMGLETRAETWMSSEGAWKHAQRVESWILRNPGFALLAGFMAYMIGQTGIQRIVFFVLMMLVAPSYGMRCVGVGNRDFVEGVSGGAWVDLVLEHGGCVTTMAQGKPTLDFELTKTTAKEVALLRTYCIEASISNITTATRCPTQGEPYLKEEQDQQYICRRDVVDRGWGNGCGLFGKGGVVTCAKFLCSGKITGNLVQIENLEYTVVVTVHNGDTHAVGNDTSNHGVTATITPRSPSVEVKLPDYGELTLDCEPRSGIDFNEMILMKMKKKTWLVHKQWFLDLPLPWTAGADTSEVHWNYKERMVTFKVPHAKRQDVTVLGSQEGAMHSALAGATEVDSGDGNHMFAGHLKCKVRMEKLRIKGMSYTMCSGKFSIDKEMAETQHGTTVVKVKYEGAGAPCKIPIEIRDVNKEKVVGRIISSTPFAENTNSVINIELEPPFGDSYIVIGVGDSALTLHWFRKGSSIGKMFESTYRGAKRMAILGETAWDFGSVGGLFTSLGKAVHQVFGSVYTTMFGGVSWMIRILIGFLVLWIGTNSRNTSMAMTCIAVGGITLFLGFTVQADMGCVVSWNGKELKCGSGIFVVDNVHTWTEQYKFQPESPARLASAILNAHKDGVCGIRSTTRLENVMWKQITNELNYVLWEGGHDLTVVAGDVKGVLTKGKRALTPPVNDLKYSWKTWGKAKIFTPEARNSTFLIDGPDTSECPNERRAWNFFEVEDYGFGMFTTNIWMKFREGSSEVCDHRLMSAAIKDQKAVHADMGYWIESSKNQTWQIEKASLIEVKTCLWPKTHTLWSNGVLESQMLIPRSYAGPFSQHNYRQGYATQTAGPWHLGKLEIDFGECPGTTVKIQEDCDHRGPSLRTTTASGKLVTQWCCRSCTMPPLRFLGEDGCWYGMEIRPLSEKEENMVKSQVTAGQGTSETFSMGLLCLTLFVEECLRRRVTRKHMILVVVITFCAIILGGLTWMDLLRALIMLGDTMSGRIGGQIHLAIMTVFKMSPGYVLGVFLRKLTSRETALMVIGMAMTTVFSIPHDLMELIDGISLGLILLKIVTHFDNTQVGTLALSLTFIRSTTPLVMAWRTIMAVFFVITLIPLCRTSCLQKQSHWVEITALILGAQALPVYLMTLMKGASRRSWPLNEGIMAVGLVSLLGSALLKNDVPLAGPMVAGGLLLAAYVMSGSSADLSLEKAANVQWDEMADITGSSPIIEVKQDEDGSFSIRDVEETNMITLLVKLALITVSGLYPLAIPVTMALWYIWQVKTQRSGALWDVPSPAATQKATLSEGVYRIMQRGLFGKTQVGVGIHMEGVFHTMWHVTRGSVICHETGRLEPSWADVRNDMISYGGGWRLGDKWDKEEDVQVLAIEPGKNPRHVQTKPGLFKTLTGEIGAVTLDFKPGTSGSPIINKKGKVIGLYGNGVVTKSGDYVSAITQAERIGEPDYEVDEDIFRKKRLTIMDLHPGAGKTKRILPSIVREALKRRLRTLILAPTRVVAAEMEEALRGLPIRYQTPAVKSEHTGREIVDLMCHATFTTRLLSSTRVPNYNLIVMDEAHFTDPCSVAARGYISTRVEMGEAAAIFMTATPPGSIDPFPQSNSPIEDIEREIPERSWNTGFDWITDYQGKTVWFVPSIKAGNDIANCLRKSGKRVIQLSRKTFDTEYPKTKLTDWDFVVTTDISEMGANFRAGRVIDPRRCLKPVILTDGPERVILAGPIPVTPASAAQRRGRIGRNPAQEDDQYVFSGDPLKNDEDHAHWTEAKMLLDNIYTPEGIIPTLFGPEREKTQAIDGEFRLRGEQRKTFVELMRRGDLPVWLSYKVASAGISYKDREWCFTGERNNQILEENMEVEIWTREGEKKKLRPKWLDARVYADPMALKDFKEFASGRKSTTLDILTEIATLPTYLSSKAKLALDNIVMLHTTEKGGRAYQHALNELPESLETLMLVALLGAMTAGIFLFFMQGKGIGKLSMGLIAIAVASGLLWVAEIQPQWIAASIILEFFLMVLLIPEPEKQRTPQDNQLIYVILTILTIIGLIAANEMGLIEKTKTDFGFYQVKTETTILDVDLRPASAWTLYAVATTILTPMLRHTIENTSANLSLAAIANQAAVLMGLGKGWPLHRMDLGVPLLAMGCYSQVNPTTLTASLVMLLIHYAIIGPGLQAKATREAQKRTAAGIMKNPTVDGITVIDLEPISYDPKFEKQLGQVMLLVLCVGQLLLMRTTWALCEVLTLATGPIMTLWEGNPGRFWNTTIAVSTANIFRGSYLAGAGLAFSLIKNAQTPRRGTGTTGETLGEKWKRQLNSLDRKEFEEYKRSGILEVDRTEAKSALRDGSKIKHAVSRGSSKIRWIVERGMIKPKGKVVDLGCGRGGWSYYMATLKNVTEVKGYTKGGPGHEEPIPMATYGWNLVKLHSGVDVFYKPTEQVDTLLCDIGESSSNPTIEEGRTLRILKMVEPWLSSKPEFCIKVLNPYMPTVIEELEKLQRRHGGSLVRCPLSRNSTHEMYWVSGASGNIVSSVNTISKMLLNRFTTRHRKPTYEKDVDLGAGTRSVSTETEKPDMTIIGRRLQRLQEEHKETWHYDQENPYRTWAYHGSYEAPSTGSASSMVNGVVKLLTKPWDVIPMVTQLAMTDTTPFGQQRVFKEKVDTRTPQPKLGTRMIMTTTANWLWALLGKKKSPRLCTREEFISKVRSNAAIGAVFQEEQGWTSASEAVNDSRFWELVDKERALHQEGKCESCVYNMMGKREKKLGEFGRAKGSRAIWYMWLGARFLEFEALGFLNEDHWFSRENSWSGVEGEGLHSLGYILEDIDKKDGDLIYADDTAGWDTRITEDDLLNEELITEQMAPHHKTLAKAIFKLTYQNKVVKVLRPTPKGAVMDIISRKDQRGSGQVGTYGLNTFTNMEVQLIRQMEAEGVITQDDMQNPKGLKERVEKWLKECGVDRLKRMAISGDDCVVKPLDERFSTSLLFLNDMGKVRKDVPQWEPSKGWKNWQEVPFCSHHFHKIFMKDGRSLVVPCRNQDELIGRARISQGAGWSLRETACLGKAYAQMWSLMYFHRRDLRLASMAICSAVPTEWFPTSRTTWSIHAQHQWMTTEDMLKVWNRVWIEDNPNMTDKTPVHSWEDIPYLGKREDLWCGSLIGLSSRATWAKNIHTAITQVRNLIGKEEYVDYMPVMKRYSAPSESEGVL

SEQ ID NO: 5229 - protein, 3288 aa, Artificial Sequence
  derived and/or modified protein sequence (wt) from DENV-4__JQ915089__SS-prME
STMTLLCLIPTVMAFHLSTRDGEPLMIVAKHERGRPLLFKTTEGINKCTLIAMDLGEMCEDTVTYKCPLLVNTEPEDIDCWCNLTSTWVMYGTCTQSGERRREKRSVALTPHSGMGLETRAETWMSSEGAWKHAQRVESWILRNPGFALLAGFMAYMIGQTGIQRTVFFVLMMLVAPSYGMRCVGVGNRDFVEGVSGGAWVDLVLEHGGCVTTMAQGKPTLDFELTKTTAKEVALLRTYCIEASISNITTATRCPTQGEPYLKEEQDQQYICRRDVVDRGWGNGCGLFGKGGVVTCAKFLCSGKITGNLVQIENLEYTVVVTVHNGDTHAVGNDTSNHGVTATITPRSPSVEVKLPDYGELTLDCEPRSGIDFNEMILMKMKKKTWLVHKQWFLDLPLPWTAGADTSEVHWNYKERMVTFKVPHAKRQDVTVLGSQEGAMHSALAGATEVDSGDGNHMFAGHLKCKVRMEKLRIKGMSYTMCSGKFSIDKEMAETQHGTTVVKVKYEGAGAPCKIPIEIRDVNKEKVVGRIISSTPFAENTNSVINIELEPPFGDSYIVIGVGDSALTLHWFRKGSSIGKMFESTYRGAKRMAILGETAWDFGSVGGLFTSLGKAVHQVFGSVYTTMFGGVSWMIRILIGFLVLWIGTNSRNTSMAMTCIAVGGITLFLGFTVQADMGCVVSWNGKELKCGSGIFVVDNVHTWTEQYKFQPESPARLASAILNAHKDGVCGIRSTTRLENVMWKQITNELNYVLWEGGHDLTVVAGDVKGVLTKGKRVLTPPVNDLKYSWKTWGKAKIFTPEARNSTFLIDGPDTSECPNERRAWNFFEVEDYGFGMFTTNIWMKFREGSSEVCDHRLMSAAIKDQKAVHADMGYWIESSKNQTWQIEKASLIEVKTCLWPKTHTLWSNGVLESQMLIPRSYAGPFSQHNYRQGYATQTAGPWHLGKLEIDFGECPGTTVKIQEDCDHRGPSLRTTTASGKLVTQWCCRSCTMPPLRFLGEDGCWYGMEIRPLSEKEENMVKSQVTAGQGTSETFSMGLLCLTLFVEECLRRRVTRKHMILVVVITFCAIILGGLTWMDLLRALIMLGDTMSGRIGGQIHLAIMTVFKMSPGYVLGVFLRKLTSRETALMVIGMAMTTVFSIPHDLMELIDGISLGLILLKIVTHFDNTQVGTLALSLTFIRSTTPLVMAWRTIMAVFFVITLIPLCRTSCLQKQSHWVEITALILGAQALPVYLMTLMKGASSRSWPLNEGIMAVGLVSLLGSALLKNDVPLAGPMVAGGLLLAAYVMSGSSADLSLEKAANVQWDEMADITGSSPIIEVKQDEDGSFSIRDVEETNMITLLVKLALITVSGLYPLAIPVTMALWYIWQVKTQRSGALWDVPSPAATQKATLSEGVYRIMQRGLFGKTQVGVGIHMEGVFHTMWHVTRGSVICHETGRLEPSWADVRNDMISYGGGWRLGDKWDKEEDVQVLAIEPGKNPRHVQTKPGLFKTLTGEIGAVTLDFKPGTSGSPIINKKGKVIGLYGNGVVTKSGDYVSAITQAERIGEPDYEIDEDIFRKKRLTIMDLHPGAGKTKRILPSIVREALKRRLRTLILAPTRVVAAEMEEALRGLPIRYQTPAVKSEHTGREIVDLMCHATFTTRLLSSTRVPNYNLIVMDEAHFTDPCSVAARGYISTRVEMGEAAAIFMTATPPGSIDPFPQSNSPIEDIEREIPERSWNTGFDWITDYQGKTVWFVPSIKAGNDIANCLRKSGKRVIQLSRKTFDTEYPKTKLTDWDFVVTTDISEMGANFRAGRVIDPRRCLKPVILTDGPERVILAGPIPVTPASAAQRRGRIGRNPAQEDDQYVFSGDPLKNDEDHAHWTEAKMLLDNIYTPEGIIPTLFGPEREKTQAIDGEFRLRGEQRKTFVELMRRGDLPVWLSYKVASAGISYKDREWCFTGERNNQILEENMEVEIWTREGEKKKLRPKWLDARVYADPMALKDFKEFASGRKSTTLDILTEIATLPTYLSSKAKLALDNIVMLHTTEKGGRAYQHALNELPESLETLMLVALLGAMTAGIFLFFMQGKGIGKLSMGLIAIAVASGLLWVAEIQPQWIAASIILEFFLMVLLIPEPEKQRTPQDNQLIYVILTILTIIGLIAANEMGLIEKTKTDFGFYQVKTETTILDVDLRPASAWTLYAVATTILTPMLRHTIENTSANLSLAAIANQAAVLMGLGKGWPLHRMDLGVPLLAMGCYSQVNPTTLTASLVMLLIHYAIIGPGLQAKATREAQKRTAAGIMKNPTVDGITVIDLEPISYDPKFEKQLGQVMLLVLCVGQLLLMRTTWALCEVLTLATGPIMTLWEGNPGRFWNTTIAVSTANIFRGSYLAGAGLAFSLIKNAQTPRRGTGTTGETLGEKWKRQLNSLDRKEFEEYKRSGILEVDRTEAKSALRDGSKIKHAVSRGSSKIRWIVERGMIKPKGKVVDLGCGRGGWSYYMATLKNVTEVKGYTKGGPGHEEPIPMATYGWNLVKLHSGVDVFYKPTEQVDTLLCDIGESSSNPTIEEGRTLRILKMVEPWLSSKPEFCIKVLNPYMPTVIEELEKLQRRHGGSLVRCPLSRNSTHEMYWVSGASGNIVSSVNTISKMLLNRFTTRHRKPTYEKDVDLGAGTRSVSTETEKPDMTIIGRRLQRLQEEHKETWHYDQENPYRTWAYHGSYEAPSTGSASSMVNGVVKLLTKPWDVIPMVTQLAMTDTTPFGQQRVFKEKVDTRTPQPKLGTRMIMTTTANWLWALLGKKKSPRLCTREEFISKVRSNAAIGAVFQEEQGWTSASEAVNDSRFWELVDKERALHQEGKCESCVYNMMGKREKKLGEFGRAKGSRAIWYMWLGARFLEFEALGFLNEDHWFSRENSWSGVEGEGLHRLGYILEDIDKKDGDLIYADDTAGWDTRITEDDLLNEELITEQMAPHHKTLAKAIFKLTYQNKVVKVLRPTPKGAVMDIISRKDQRGSGQVGTYGLNTFTNMEVQLIRQMEAEGVITQDDMQNPKGLKERVEKWLKECGVDRLKRMAISGDDCVVKPLDERFSTSLLFLNDMGKVRKDVPQWEPSKGWKNWQEVPFCSHHFHKIFMKDGRSLVVPCRNQDELIGRARISQGAGWSLRETACLGKAYAQMWSLMYFHRRDLRLASMAICSAVPTEWFPTSRTTWSIHAQHQWMTTEDMLKVWNRVWIEDNPNMTDKTPVHSWEDIPYLGKREDLWCGSLIGLSSRATWAKNIHTAITQVRNLIGKEEYVDYMPVMKRYSAPSESEGVL

SEQ ID NO: 5230 - protein, 3288 aa, Artificial Sequence
  derived and/or modified protein sequence (wt) from DENV-4__JQ915082__SS-prME
STMTLLCLIPTVMAFHLSTRDGEPLMIVAKHERGRPLLFKTTEGINKCTLIAMDLGEMCEDTVTYKCPLLVNTEPEDIDCWCNLTSTWVMYGTCTQSGERRREKRSVALTPHSGMGLETRAETWMSSEGAWKHAQRVESWILRNPGFALLAGFMAYMIGQTGIQRIVFFVLMMLVAPSYGMRCVGVGNRDFVEGVSGGAWVDLVLEHGGCVTTMAQGKPTLDFELTKTTAKEVALLRTYCIEASISNITTATRCPTQGEPYLKEEQDQQYICRRDVVDRGWGNGCGLFGKGGVVTCAKFLCSGKITGNLVQIENLEYTVVVTVHNGDTHAVGNDTSNHGVTATITPRSPSVEVKLPDYGELTLDCEPRSGIDFNEMILMKMKKKTWLVHKQWFLDLPLPWTAGADTSEVHWNYKERMVTFKVPHAKRQDVTVLGSQEGAMHSALAGATEVDSGDGNHMFAGHLKCKVRMEKLRIKGMSYTMCSGKFSIDKEMAETQHGTTVVKVKYEGAGAPCKIPIEIRDVNKEKVVGRIISSTPFAENTNSVINIELEPPFGDSYIVIGVGDSALTLHWFRKGSSIGKMFESTYRGAKRMAILGETAWDFGSVGGLFTSLGKAVHQVFGSVYTTMFGGVSWMIRILIGFLVLWIGTNSRNTSMAMTCIAVGGITLFLGFTVQADMGCVVSWNGKELKCGSGIFVVDNVHTWTEQYKFQPESPARLASAILNAHKDGVCGIRSTTRLENVMWKQITNELNYVLWEGGHDLTVVAGDVKGVLTKGKRALTPPVNDLKYSWKTWGKAKIFTPEARNSTFLIDGPDTSECPNERRAWNFFEVEDYGFGMFTTNIWMKFREGSSEVCDHRLMSAAIKDQKAVHADMGYWIESSKNQTWQIEKASLIEVKTCLWPKTHTLWSNGVLESQMLIPRSYAGPFSQHNYRQGYATQTAGPWHLGKLEIDFGECPGTTVKIQEDCDHRGPSLRTTTASGKLVTQWCCRSCTMPPLRFLGEDGCWYGMEIRPLSEKEENMVKSQVTAGQGTSETFSMGLLCLTLFVEECLRRRVTRKHMILVVVITFCAIILGGLTWMDLLRALIMLGDTMSGRIGGQIHLAIMTVFKMSPGYVLGVFLRKLTSRETALMVIGMAMTTVFSIPHDLMELIDGISLGLILLKIVTHFDNTQVGTLALSLTFIRSTTPLVMAWRTIMAVFFVITLIPLCRTSCLQKQSHWVEITALILGAQALPVYLMTLMKGASRRSWPLNEGIMAVGLVSLLGSALLKNDVPLAGPMVAGGLLLAAYVMSGSSADLSLEKAANVQWDEMADITGSSPIIEVKQDEDGSFSIRDVEETNMITLLVKLALITVSGLYPLAIPVTMALWYIWQVKTQRSGALWDVPSPAATQKATLSEGVYRIMQRGLFGKTQVGVGIHMEGVFHTMWHVTRGSVICHETGRLEPSWADVRNDMISYGGGWRLGDKWDKEEDVQVLAIEPGKNPRHVQTKPGLFKTLTGEIGAVTLDFKPGTSGSPIINKKGKVIGLYGNGVVTKSGDYVSAITQAERIGEPDYEVDEDIFRKKRLTIMDLHPGAGKTKRILPSIVREALKRRLRTLILAPTRVVAAEMEEALRGLPIRYQTPAVKSEHTGREIVDLMCHATFTTRLLSSTRVPNYNLIVMDEAHFTDPCSVAARGYISTRVEMGEAAAIFMTATPPGSIDPFPQSNSPIEDIEREIPERSWNTGFDWITDYQGKTVWFVPSIKAGNDIANCLRKSGKRVIQLSRKTFDTEYPKTKLTDWDFVVTTDISEMGANFRAGRVIDPRRCLKPVILTDGPERVILAGPIPVTPASAAQRRGRIGRNPAQEDDQYVFSGDPLKNDEDHAHWTEAKMLLDNIYTPEGIIPTLFGPEREKTQAIDGEFRLRGEQRKTFVELMRRGDLPVWLSYKVASAGISYKDREWCFTGERNNQILEENMEVEIWTREGEKKKLRPKWLDARVYADPMALKDFKEFASGRKSTTLDILTEIATLPTYLSSKAKLALDNIVMLHTTEKGGRAYQHALNELPESLETLMLVALLGAMTAGIFLFFMQGKGIGKLSMGLIAIAVASGLLWVAEIQPQWIAASIILEFFLMVLLIPEPEKQRTPQDNQLIYVILTILTIIGLIAANEMGLIEKTKTDFGFYQVKTETTILDVDLRPASAWTLYAVATTILTPMLRHTIENMSANLSLAAIANQAAVLMGLGKGWPLHRMDLGVPLLAMGCYSQVNPTTLTASLVMLLIHYAIIGPGLQAKATREAQKRTAAGIMKNPTVDGITVIDLEPISYDPKFEKQLGQVMLLVLCVGQLLLMRTTWALCEVLTLATGPIITLWEGNPGRFWNTTIAVSTANIFRGSYLAGAGLAFSLIKNAQTPRRGTGTTGETLGEKWKRQLNSLDRKEFEEYKRSGILEVDRTEAKSALRDGSKIKHAVSRGSSKIRWIVERGMIKPKGKVVDLGCGRGGWSYYMATLKNVTEVKGYTKGGPGHEEPIPMATYGWNLVKLHSGVDVFYKPTEQVDTLLCDIGESSSNPTIEEGRTLRILKMVEPWLSSKPEFCIKVLNPYMPTVIEELEKLQRRHGGSLVRCPLSRNSTHEMYWVSGASGNIVSSVNTISKMLLNRFTTRHRKPTYEKDVDLGAGTRSVSTETEKPDMTIIGRRLQRLQEEHKETWHYDQENPYRTWAYHGSYEAPSTGSASSMVNGVVKLLTKPWDVIPMVTQLAMTDTTPFGQQRVFKEKVDTRTPQPKLGTRMIMTTTANWLWALLGKKKSPRLCTREEFISKVRSNAAIGAVFQEEQGWTSASEAVNDSRFWELVDKERALHQEGKCESCVYNMMGKREKKLGEFGRAKGSRAIWYMWLGARFLEFEALGFLNEDHWFSRENSWSGVEGEGLHRLGYILEDIDKKDGDLIYADDTAGWDTRITEDDLLNEELITEQMAPHHKTLAKAIFKLTYQNKVVKVLRPTPKGAVMDIISRKDQRGSGQVGTYGLNTFTNMEVQLIRQMEAEGVITQDDMQNPKGLKERVEKWLKECGVDRLKRMAISGDDCVVKPLDERFSTSLLFLNDMGKVRKDVPQWDPSKGWKNWQEVPFCSHHFHKIFMKDGRSLVVPCRNQDELIGRARISQGAGWSLRETACLGKAYAQMWSLMYFHRRDLRLASMAICSAVPTEWFPTSRTTWSIHAQHQWMTTEDMLKVWNRVWIEDNPNMTDKTPVHSWEDIPYLGKREDLWCGSLIGLSSRATWAKNIHTAITQVRNLIGKEEYVDYMPVMKRYSAPSESEGVL

SEQ ID NO: 5231 - protein, 3288 aa, Artificial Sequence
  derived and/or modified protein sequence (wt) from DENV-4__JQ915081__SS-prME
STMTLLCLIPTVMAFHLSTRDGEPLMIVAKHERGRPLLFKTTEGINKCTLIAMDLGEMCEDTVTYKCPLLVNTEPEDIDCWCNLTSTWVMYGTCTQSGERRREKRSVALTPHSGMGLETRAETWMSSEGAWKHAQRVESWILRNPGFALLAGFMAYMIGQTGIQRIVFFVLMMLVAPSYGMRCVGVGNRDFVEGVSGGAWVDLVLEHGGCVTTMAQGKPTLDFELTKTTAKEVALLRTYCIEASISNITTATRCPTQGEPYLKEEQDQQYICRRDVVDRGWGNGCGLFGKGGVVTCAKFLCSGKITGNLVQIENLEYTVVVTVHNGDTHAVGNDTSNHGVTATITPRSPSVEVKLPDYGELTLDCEPRSGIDFNEMILMKMKKKTWLVHKQWFLDLPLPWTAGADTSEVHWNYKERMVTFKVPHAKRQDVTVLGSQEGAMHSALAGATEVDSGDGNHMFAGHLKCKVRMEKLRIKGMSYTMCSGKFSIDKEMAETQHGTTVVKVKYEGAGAPCKIPIEIRDVNKEKVVGRIISSTPFAENTNSVINIELEPPFGDSYIVIGVGDSALTLHWFRKGSSIGKMFESTYRGAKRMAILGETAWDFGSVGGLFTSLGKAVHQVFGSVYTTMFGGVSWMIRILIGFLVLWIGTNSRNTSMAMTCIAVGGITLFLGFTVQADMGCVVSWNGKELKCGSGIFVVDNVHTWTEQYKFQPESPARLASAILNAHKDGVCGIRSTTRLENVMWKQITNELNYVLWEGGHDLTVVAGDVKGVLTKGKRALTPPVNDLKYSWKTWGKAKIFTPEARNSTFLIDGPDTSECPNERRAWNFFEVEDYGFGMFTTNIWMKFREGSSEVCDHRLMSAAIKDQKAVHADMGYWIESSKNQTWQIEKASLIEVKTCLWPKTHTLWSNGVLESQMLIPRSYAGPFSQHNYRQGYATQTAGPWHLGKLEIDFGECPGTTVKIQEDCDHRGPSLRTTTASGKLVTQWCCRSCTMPPLRFLGEDGCWYGMEIRPLSEKEENMVKSQVTAGQGTSETFSMGLLCLTLFVEECLRRRVTRKHMILVVVITFCAIILGGLTWMDLLRALIMLGDTMSGRIGGQIHLAIMTVFKMSPGYVLGVFLRKLTSRETALMVIGMAMTTVFSIPHDLMELIDGISLGLILLKIVTHFDNTQVGTLALSLTFIRSTTPLVMAWRTIMAVFFVITLIPLCRTSCLQKQSHWVEITALILGAQALPVYLMTLMKGASRRSWPLNEGIMAVGLVSLLGSALLKNDVPLAGPMVAGGLLLAAYVMSGSSADLSLEKAANVQWDEMADITGSSPIIEVKQDEDGSFSIRDVEETNMITLLVKLALITVSGLYPLAIPVTMALWYIWQVKTQRSGALWDVPSPAATQKATLSEGVYRIMQRGLFGKTQVGVGIHMEGVFHTMWHVTRGSVICHETGRLEPSWADVRNDMISYGGGWRLGDKWDKEEDVQVLAIEPGKNPRHVQTKPGLFKTLTGEIGAVTLDFKPGTSGSPIINKKGKVIGLYGNGVVTKSGDYVSAITQAERIGEPDYEVDEDIFRKKRLTIMDLHPGAGKTKRILPSIVREALKRRLRTLILAPTRVVAAEMEEALRGLPIRYQTPAVKSEHTGREIVDLMCHATFTTRLLSSTRVPNYNLIVMDEAHFTDPCSVAARGYISTRVEMGEAAAIFMTATPPGSIDPFPQSNSPIEDIEREIPERSWNTGFDWITDYQGKTVWFVPSIKAGNDIANCLRKSGKRVIQLSRKTFDTEYPKTKLTDWDFVVTTDISEMGANFRAGRVIDPRRCLKPVILTDGPERVILAGPIPVTPASAAQRRGRIGRNPAQEDDQYVFSGDPLKNDEDHAHWTEAKMLLDNIYTPEGIIPTLFGPEREKTQAIDGEFRLRGEQRKTFVELMRRGDLPVWLSYKVASAGISYKDREWCFTGERNNQILEENMEVEIWTREGEKKKLRPKWLDARVYADPMALKDFKEFASGRKSTTLDILTEIATLPTYLSSKAKLALDNIVMLHTTEKGGRAYQHALNELPESLETLMLVALLGAMTAGIFLFFMQGKGIGKLSMGLIAIAVASGLLWVAEIQPQWIAASIILEFFLMVLLIPEPEKQRTPQDNQLIYVILTILTIIGLIAANEMGLIEKTKTDFGFYQVKTETTILDVDLRPASAWTLYAVATTILTPMLRHTIENMSANLSLAAIANQAAVLMGLGKGWPLHRMDLGVPLLAMGCYSQVNPTTLTASLVMLLIHYAIIGPGLQAKATREAQKRTAAGIMKNPTVDGITVIDLEPISYDPKFEKQLGQVMLLVLCVGQLLLMRTTWALCEVLTLATGPIITLWEGNPGRFWNTTIAVSTANIFRGSYLAGAGLAFSLIKNAQTPRRGTGTTGETLGEKWKRQLNSLDRKEFEEYKRSGILEVDRTEAKSALRDGSKIKHAVSRGSSKIRWIVERGMIKPKGKVVDLGCGRGGWSYYMATLKNVTEVKGYTKGGPGHEEPIPMATYGWNLVKLHSGVDVFYKPTEQVDTLLCDIGESSSNPTIEEGRTLRILKMVEPWLSSKPEFCIKVLNPYMPTVIEELEKLQRRHGGSLVRCPLSRNSTHEMYWVSGASGNIVSSVNTISKMLLNRFTTRHRKPTYEKDVDLGAGTRSVSIETEKPDMTIIGRRLQRLQEEHKETWHYDQENPYRTWAYHGSYEAPSTGSASSMVNGVVKLLTKPWDVIPMVTQLAMTDTTPFGQQRVFKEKVDTRTPQPKLGTRMIMTTTANWLWALLGKKKSPRLCTREEFISKVRSNAAIGAVFQEEQGWTSASEAVNDSRFWELVDKERALHQEGKCESCVYNMMGKREKKLGEFGRAKGSRAIWYMWLGARFLEFEALGFLNEDHWFSRENSWSGVEGEGLHRLGYILEDIDKKDGDLIYADDTAGWDTRITEDDLLNEELITEQMAPHHKTLAKAIFKLTYQNKVVKVLRPTPKGAVMDIISRKDQRGSGQVGTYGLNTFTNMEVQLIRQMEAEGVITQDDMQNPKGLKERVEKWLKECGVDRLKRMAISGDDCVVKPLDERFSTSLLFLNDMGKVRKDVPQWDPSKGWKNWQEVPFCSHHFHKIFMKDGRSLVVPCRNQDELIGRARISQGAGWSLRETACLGKAYAQMWSLMYFHRRDLRLASMAICSAVPTEWFPTSRTTWSIHAQHQWMTTEDMLKVWNRVWIEDNPNMTDKTPVHSWEDIPYLGKREDLWCGSLIGLSSRATWAKNIHTAITQVRNLIGKEEYVDYMPVMKRYSAPSESEGVL

SEQ ID NO: 5232 - protein, 3288 aa, Artificial Sequence
  derived and/or modified protein sequence (wt) from DENV-4__JQ915084__SS-prME
STMTLLCLIPTVMAFHLSTRDGEPLMIVAKHERGRPLLFKTTEGINKCTLIAMDLGEMCEDTVTYKCPLLVNTEPEDIDCWCNLTSTWVMYGTCTQSGERRREKRSVALTPHSGMGLETRAETWMSSEGAWKHAQRVESWILRNPGFALLAGFMAYMIGQTGIQRIVFFVLMMLVAPSYGMRCVGVGNRDFVEGVSGGAWVDLVLEHGGCVTTMAQGKPTLDFELTKTTAKEVALLRTYCIEASISNITTATRCPTQGEPYLKEEQDQQYICRRDVVDRGWGNGCGLFGKGGVVTCAKFLCSGKITGNLVQIENLEYTVVVTVHNGDTHAVGNDTSNHGVTATITPRSPSVEVKLPDYGELTLDCEPRSGIDFNEMILMKMKKKTWLVHKQWFLDLPLPWTAGADTSEVHWNYKERMVTFKVPHAKRQDVTVLGSQEGAMHSALAGATEVDSGDGNHMFAGHLKCKVRMEKLRIKGMSYTMCSGKFSIDKEMAETQHGTTVVKVKYEGAGAPCKIPIEIRDVNKEKVVGRIISSTPFAENTNSVINIELEPPFGDSYIVIGVGDSALTLHWFRKGSSIGKMFESTYRGAKRMAILGETAWDFGSVGGLFTSLGKAVHQVFGSVYTTMFGGVSWMIRILIGFLVLWIGTNSRNTSMAMTCIAVGGITLFLGFTVQADMGCVVSWNGKELKCGSGIFVVDNVHTWTEQYKFQPESPARLASAILNAHKDGVCGIRSTTRLENVMWKQITNELNYVLWEGGHDLTVVAGDVKGVLTKGKRALTPPVNDLKYSWKTWGKAKIFTPEARNSTFLIDGPDTSECPNERRAWNFFEVEDYGFGMFTTNIWMKFREGSSEVCDHRLMSAAIKDQKAVHADMGYWIESSKNQTWQIEKASLIEVKTCLWPKTHTLWSNGVLESQMLIPRSYAGPFSQHNYRQGYATQTAGPWHLGKLEIDFGECPGTTVKIQEDCDHRGPSLRTTTASGKLVTQWCCRSCTMPPLRFLGEDGCWYGMEIRPLSEKEENMVKSQVTAGQGTSETFSMGLLCLTLFVEECLRRRVTRKHMILVVVITFCAIILGGLTWMDLLRALIMLGDTMSGRIGGQIHLAIMTVFKMSPGYVLGVFLRKLTSRETALMVIGMAMTTVFSIPHDLMELIDGISLGLILLKIVTHFDNTQVGTLALSLTFMRSTTPLVMAWRTIMAVFFVITLIPLCRTSCLQKQSHWVEITALILGAQALPVYLMTLMKGASRRSWPLNEGIMAVGLVSLLGSALLKNDVPLAGPMVAGGLLLAAYVMSGSSADLSLEKAANVQWDEMADITGSSPIIEVKQDEDGSFSIRDVEETNMITLLVKLALITVSGLYPLAIPVTMALWYIWQVKTQRSGALWDVPSPAATQKATLSEGVYRIMQRGLFGKTQVGVGIHMEGVFHTMWHVTRGSVICHETGRLEPSWADVRNDMISYGGGWRLGDKWDKEEDVQVLAIEPGKNPRHVQTKPGLFKTLTGEIGAVTLDFKPGTSGSPIINKKGKVIGLYGNGVVTKSGDYVSAITQAERIGEPDYEVDEDIFRKKRLTIMDLHPGAGKTKRILPSIVREALKRRLRTLILAPTRVVAAEMEEALRGLPIRYQTPAVKSEHTGREIVDLMCHATFTTRLLSSTRVPNYNLIVMDEAHFTDPCSVAARGYISTRVEMGEAAAIFMTATPPGSIDPFPQSNSPIEDIEREIPERSWNTGFDWITDYQGKTVWFVPSIKAGNDIANCLRKSGKRVIQLSRKTFDTEYPKTKLTDWDFVVTTDISEMGANFRAGRVIDPRRCLKPVILTDGPERVILAGPIPVTPASAAQRRGRIGRNPAQEDDQYVFSGDPLKNDEDHAHWTEAKMLLDNIYTPEGIIPTLFGPEREKTQAIDGEFRLRGEQRKTFVELMRRGDLPVWLSYKVASAGISYKDREWCFTGERNNQILEENMEVEIWTREGEKKKLRPKWLDARVYADPMALKDFKEFASGRKSTTLDILTEIATLPTYLSSKAKLALDNIVMLHTTEKGGRAYQHALNELPESLETLMLVALLGAMTAGIFLFFMQGKGIGKLSMGLIAIAVASGLLWVAEIQPQWIAASIILEFFLMVLLIPEPEKQRTPQDNQLIYVILTILAIIGLIAANEMGLIEKTKTDFGFYQVKTETTILDVDLRPASAWTLYAVATTILTPMLRHTIENTSANLSLAAIANQAAVLMGLGKGWPLHRMDLGVPLLAMGCYSQVNPTTLTASLVMLLIHYAIIGPGLQAKATREAQKRTAAGIMKNPTVDGITVIDLEPISYDPKFEKQLGQVMLLVLCVGQLLLMRTTWALCEVLTLATGPIMTLWEGNPGRFWNTTIAVSTANIFRGSYLAGAGLAFSLIKNAQTPRRGTGTTGETLGEKWKRQLNSLDRKEFEEYKRSGILEVDRTEAKSALRDGSKIKHAVSRGSSKIRWIVERGMIKPKGKVVDLGCGRGGWSYYMATLKNVTEVKGYTKGGPGHEEPIPMATYGWNLVKLHSGVDVFYKPTEQVDTLLCDIGESSSNPTIEEGRTLRILKMVEPWLSSKPEFCIKVLNPYMPTVIEELEKLQRRHGGSLVRCPLSRNSTHEMYWVSGASGNIVSSVNTISKMLLNRFTTRHRKPTYEKDVDLGAGTRSVSTETEKPDMTIIGRRLQRLQEEHKETWHYDQENPYRTWAYHGSYEAPSTGSASSMVNGVVKLLTKPWDVIPMVTQLAMTDTTPFGQQRVFKEKVDTRTPQPKIGTRMIMTTTANWLWALLGKKKSPRLCTREEFISKVRSNAAIGAVFQEEQGWTSASEAVNDSRFWELVDKERALHQEGKCESCVYNMMGKREKKLGEFGRAKGSRAIWYMWLGARFLEFEALGFLNEDHWFSRENSWSGVEGEGLHRLGYILEDIDKKDGDLIYADDTAGWDTRITEDDLLNEELITEQMAPHHKTLAKAIFKLTYQNKVVKVLRPTPKGAVMDIISRKDQRGSGQVGTYGLNTFTNMEVQLIRQMEAEGVITQDDMQNPKGLKERVEKWLKECGVDRLKRMAISGDDCVVKPLDERFSTSLLFLNDMGKVRKDVPQWEPSKGWKNWQEVPFCSHHFHKIFMKDGRSLVVPCRNQDELIGRARISQGAGWSLRETACLGKAYAQMWSLMYFHRRDLRLASMAICSAVPTEWFPTSRTTWSIHAQHQWMTTEDMLKVWNRVWIEDNPNMTDKTPVHSWEDIPYLGKREDLWCGSLIGLSSRATWAKNIHTAITQVRNLIGKEEYVDYMPVMKRYSSPSESEGVL

SEQ ID NO: 5233 - protein, 3288 aa, Artificial Sequence
  derived and/or modified protein sequence (wt) from DENV-4__KM190936__SS-prME
STITLLCLIPTVMAFSLSTRDGEPLMIVAKHERGRPLLFKTTEGINKCTLIAMDLGEMCEDTVTYKCPLLVNTEPEDIDCWCNLTSTWVMYGTCTQSGERRREKRSVALTPHSGMGLETRAETWMSSEGAWKHAQRVESWILRNPGFALLAGFMAYMIGQTGIQRTVFFVLMMLVAPSYGMRCVGVGNRDFVEGVSGGAWVDLVLEHGGCVTTMAQGKPTLDFELTKTTAKEVALLRTYCIEASISNITTATRCPTQGEPYLKEEQDQQYICRRDVVDRGWGNGCGLFGKGGVVTCAKFSCSGKITGNLVQIENLEYTVVVTVHNGDTHAVGNDTSNHGVTAMITPRSPSVEVKLPDYGELTLDCEPRSGIDFNEMILMKMKKKTWLVHKQWFLDLPLPWTAGADTSEVHWNYKERMVTFKVPHAKRQDVTVLGSQEGAMHSALAGATEVDSGDGNHMFAGHLKCKVRMEKLRIKGMSYTMCSGKFSIDKEMAETQHGTTVVKVKYEGAGAPCKVPIEIRDVNKEKVVGRIISSTPLAENTNSVTNIELEPPFGDSYIVIGVGNSALTLHWFRKGSSIGKMFESTYRGAKRMAILGETAWDFGSVGGLFTSLGKAVHQVFGSVYTTMFGGVSWMIRILIGFLVLWIGTNSRNTSMAMTCIAVGGITLFLGFTVQADMGCVVSWSGKELKCGSGIFVVDNVHTWTEQYKFQPESPARLASAILNAHKDGVCGIRSTTRLENVMWKQITNELNYVLWEGGHDLTVVAGDVKGVLTKGKRALTPPVSDLKYSWKTWGKAKIFTPEARNSTFLIDGPDTSECPNERRAWNSLEVEDYGFGMFTTNIWMKFREGSSEVCDHRLMSAAIKDQKAVHADMGYWIESSKNQTWQIEKASLIEVKTCLWPKTHTLWSNGVLESQMLIPKSYAGPFSQHNYRQGYATQTVGPWHLGKLEIDFGECPGTTVTIQEDCDHRGPSLRTTTASGKLVTQWCCRSCTMPPLRFLGEDGCWYGMEIRPLSEKEENMVKSQVTAGQGTSETFSMGLLCLTLFVEECLRRRVTRKHMILVVVITLCAIILGGLTWMDLLRALIMLGDTMSGRIGGQIHLAIMAVFKMSPGYVLGVFLRKLTSRETALMVIGMAMTTVLSIPHDLMELIDGISLGLILLKIVTQFDNTQVGTLALSLTFIRSTMPLVMAWRTIMAVLFVVTLIPLCRTSCLQKQSHWVEITALILGAQALPVYLMTLMKGASRRSWPLNEGIMAVGLVSLLGSALLKNDVPLAGPMVAGGLLLAAYVMSGSSADLSLEKAANVQWDEMADITGSSPIIEVKQDEDGSFSIRDVEETNMITLLVKLALITVSGLYPLAIPVTMTLWYMWQVKTQRSGALWDVPSPAATQKAALSEGVYRIMQRGLFGKTQVGVGIHMEGVFHTMWHVTRGSVICHETGRLEPSWADVRNDMISYGGGWRLGDKWDKEEDVQVLAIEPGKNPKHVQTKPGLFKTLTGEIGAVTLDFKPGTSGSPIINRKGKVIGLYGNGVVTKSGDYVSAITQAERIGEPDYEVDEDIFRKKRLTIMDLHPGAGKTKRILPSIVREALKRRLRTLILAPTRVVAAEMEEALRGLPIRYQTPAVKSEHTGREIVDLMCHATFTTRLLSSTRVPNYNLIVMDEAHFTDPSSVAARGYISTRVEMGEAAAIFMTATPPGATDPFPQSNSPIEDIEREIPERSWNTGFDWITDYQGKTVWFVPSIKAGNDIANCLRKSGKKVIQLSRKTFDTEYPKTKLTDWDFVVTTDISEMGANFRAGRVIDPRRCLKPVILTDGPERVILAGPIPVTPASAAQRRGRIGRNPAQEDDQYVFSGDPLKNDEDHAHWTEAKMLLDNIYTPEGIIPTLFGPEREKTQAIDGEFRLRGEQRKTFVELMRRGDLPVWLSYKVASAGISYKDREWCFTGERNNQILEENMEVEIWTREGEKKKLRPRWLDARVYADPMALKDFKEFASGRKSITLDILTEIASLPTYLSSRAKLALDNIVMLHTTERGGRAYQHALNELPESLETLMLVALLGAMTAGIFLFFMQGKGIGKLSMGLITIAVASGLLWVAEIQPQWIAASIILEFFLMVLLIPEPEKQRTPQDNQLIYVILTILTIIGLIAANEMGLIEKTKTDFGFYQVKTETTILDVDLRPASAWTLYAVATTILTPMLRHTIENTSANLSLAAIANQAAVLMGLGKGWPLHRMDLGVPLLAMGCYSQVNPTTLTASLVMLLVHYAIIGPGLQAKATREAQKRTAAGIMKNPTVDGITVIDLEPISYDPKFEKQLGQVMLLVLCAGQLLLMRTTWAFCEVLTLATGPILTLWEGNPGRFWNTTIAVSTANIFRGSYLAGAGLAFSLIKNAQTPRRGTGTTGETLGEKWKRQLNSLDRKEFEEYKRSGILEVDRTEAKSALKDGSKIKHAVSRGSSKIRWIVERGMVKPKGKVVDLGCGRGGWSYYMATLKNVTEVKGYTKGGPGHEEPIPMATYGWNLVKLHSGVDVFYKPTEQVDTLLCDIGESSSNPTIEEGRTLRVLKMVEPWLSSKPEFCIKVLNPYMPTVIEELEKLQRKHGGNLVRCPLSRNSTHEMYWVSGASGNIVSSVNTTSKMLLNRFTTRHRKPTYEKDVDLGAGTRSVSTETEKPDMTIIGRRLQRLQEEHKETWHYDQENPYRTWAYHGSYEAPSTGSASSMVNGVVKLLTKPWDVIPMVTQLAMTDTTPFGQQRVFKEKVDTRTPQPKPGTRMVMTTTANWLWALLGKKKNPRLCTREEFISKVRSNAAIGAVFQEEQGWTSASEAVNDSRFWELVDKERALHQEGKCESCVYNMMGKREKKLGEFGRAKGSRAIWYMWLGARFLEFEALGFLNEDHWFGRENSWSGVEGEGLHRLGYILEEIDKKDGDLMYADDTAGWDTRITEDDLQNEELITEQMAPHHKILAKAIFKLTYQNKVVKVLRPTPRGAVMDIISRKDQRGSGQVGTYGLNTFTNMEVQLIRQMEAEGVITQDDMQNPKGLKERVEKWLKECGVDRLKRMAISGDDCVVKPLDERFGTSLLFLNDMGKVRKDIPQWEPSKGWKNWQEVPFCSHHFHKIFMKDGRSLVVPCRNQDELIGRARISQGAGWSLRETACLGKAYAQMWSLMYFHRRDLRLASMAICSAVPTEWFPTSRTTWSIHAHHQWMTTEDMLKVWNRVWIEDNPNMTDKTPVHSWEDIPYLGKREDLWCGSLIGLSSRATWAKNIHTAITQVRNLIGKEEYVDYMPVMKRYSAPSESEGVL

SEQ ID NO: 5234 - protein, 3288 aa, Artificial Sequence
  derived and/or modified protein sequence (wt) from DENV-4__JQ915090__SS-prME
STMTLLCLIPTVMAFHLSTRDGEPLMIVAKHERGRPLLFKTTEGINKCTLIAMDLGEMCEDTVTYKCPLLVNTEPEDIDCWCNLTSTWVMYGTCTQSGERRREKRSVALTPHSGMGLETRAETWMSSEGAWKHAQRVESWILRNPGFALLAGFMAYMIGQTGIQRIVFFVLMMLVAPSYGMRCVGVGNRDFVEGVSGGAWVDLVLEHGGCVTTMAQGKPTLDFELAKTTAKEVALLRTYCIEASISNITTATRCPTQGEPYLKEEQDQQYICRRDVVDRGWGNGCGLFGKGGVVTCAKFLCSGKITGNLVQIENLEYTVVVTVHNGDTHAVGNDTSNHGVTATITPRSPSVEVKLPDYGELTLDCEPRSGIDFNEMILMKMKKKTWLVHKQWFLDLPLPWTAGADTSEVHWNYKERMVTFKVPHAKRQDVTVLGSQEGAMHSALAGATEVDSGDGNHMFAGHLKCKVRMEKLRIKGMSYTMCSGKFSIDKEMAETQHGTTVVKVKYEGAGAPCKIPIEIRDVNKEKVVGRIISSTPFAENTNSVINIELEPPFGDSYIVIGVGDSALTLHWFRKGSSIGKMFESTYRGAKRMAILGETAWDFGSVGGLFTSLGKAVHQVFGSVYTTMFGGVSWMIRILIGFLVLWIGTNSRNTSMAMTCIAVGGITLFLGFTVQADMGCVVSWNGKELKCGSGIFVVDNVHTWTEQYKFQPESPARLASAILNAHKDGVCGIRSTTRLENVMWKQITNELNYVLWEGGHDLTVVAGDVKGVLTKGKRALTPPVNDLKYSWKTWGKAKIFTPEARNSTFLIDGPDTSECPNERRAWNFFEVEDYGFGMFTTNIWMKFREGSSEVCDHRLMSAAIKDQKAVHADMGYWIESSKNQTWQIEKASLIEVKTCLWPKTHTLWSNGVLESQMLIPRSYAGPFSQHNYRQGYATQTAGPWHLGKLEIDFGECPGTTVKIQEDCDHRGPSLRTTTASGKLVTQWCCRSCTMPPLRFLGEDGCWYGMEIRPLSEKEENMVKSQVTAGQGTSETFSMGLLCLTLFVEECLRRRVTRKHMILVVVITFCAIILGGLTWMDLLRALIMLGDTMSGRIGGQIHLAIMTVFKMSPGYVLGVFLRKLTSRETALMVIGMAMTTVFSIPHDLMELIDGISLGLILLKIVTHFDNTQVGTLALSLTFMRSTTPLVMAWRTIMAVFFVITLIPLCRTSCLQKQSHWVEMTALILGAQALPVYLMTLMKGASRRSWPLNEGIMAVGLVSLLGSALLKNDVPLAGPMVAGGLLLAAYVMSGSSADLSLEKAANVQWDEMADITGSSPIIEVKQDEDGSFSIRDVEETNMITLLVKLALITVSGLYPLAIPVTMALWYIWQVKTQRSGALWDVPSPAATQKATLSEGVYRIMQRGLFGKTQVGVGIHMEGVFHTMWHVTRGSVICHETGRLEPSWADVRSDMISYGGGWRLGDKWDKEEDVQVLAIEPGKNPRHVQTKPGLFKTLTGEIGAVTLDFKPGTSGSPIINKKGKVIGLYGNGVVTKSGDYVSAITQAERIGEPDYEVDEDIFRKKRLTIMDLHPGAGKTKRILPSIVREALKRRLRTLILAPTRVVAAEMEEALRGLPIRYQTPAVKSEHTGREIVDLMCHATFTTRLLSSTRVPNYNLIVMDEAHFTDPCSVAARGYISTRVEMGEAAAIFMTATPPGSIDPFPQSNSPIEDIEREIPERSWNTGFDWITDYQGKTVWFVPSIKAGNDIANCLRKSGKRVIQLSRKTFDTEYPKTKLTDWDFVVTTDISEMGANFRAGRVIDPRRCLKPVILTDGPERVILAGPIPVTPASAAQRRGRIGRNPAQEDDQYVFSGDPLKNDEDHAHWTEAKMLLDNIYTPEGIIPTLFGPEREKTQAIDGEFRLRGEQRKTFVELMRRGDLPVWLSYKVASAGISYKDREWCFTGERNNQILEENMEVEIWTREGEKKKLRPKWLDARVYADPMALKDFKEFASGRKSTTLDILTEIATLPTYLSSKAKLALDNIVMLHTTEKGGRAYQHALNELPESLETLMLVALLGAMTAGIFLFFMQGKGIGKLSMGLIAIAVASGLLWVAEIQPQWIAASIILEFFLMVLLIPEPEKQRTPQDNQLIYVILTILTIIGLIAANEMGLIEKTKTDFGFYQVKTETTILDVDLRPASAWTLYAVATTILTPMLRHTIENMSANLSLAAIANQAAVLMGLGKGWPLHRMDLGVPLLAMGCYSQVNPTTLTASLVMLLIHYAIIGPGLQAKATREAQKRTAAGIMKNPTVDGITVIDLEPISYDPKFEKQLGQVMLLVLCVGQLLLMRTTWALCEVLTLATGPIMTLWEGNPGRFWNTTIAVSTANIFRGSYLAGAGLAFSLIKNAQTPRRGTGTTGETLGEKWKRQLNSLDRKEFEEYKRSGILEVDRTEAKSALRDGSKIKHAVSRGSSKIRWIVERGMIKPKGKVVDLGCGRGGWSYYMATLKNVTEVKGYTKGGPGHEEPIPMATYGWNLVKLHSGVDVFYKPTEQVDTLLCDIGESSSNPTIEEGRTLRILKMVEPWLSSKPEFCIKVLNPYMPTVIEELEKLQRRHGGSLVRCPLSRNSTHEMYWVSGASGNIVSSVNTISKMLLNRFTTRHRKPTYEKDVDLGAGTRSVSTETEKPDMTIIGRRLQRLQEEHKETWHYDQENPYRTWAYHGSYEAPSTGSASSMVNGVVKLLTKPWDVIPMVTQLAMTDTTPFGQQRVFKEKVDTRTPQPKLGTRMIMTTTANWLWALLGKKKSPRLCTREEFISKVRSNAAIGAVFQEEQGWTSAIEAVNDSRFWELVDKERALHQEGKCESCVYNMMGKREKKLGEFGRAKGSRAIWYMWLGARFLEFEALGFLNEDHWFSRENSWSGVEGEGLHRLGYILEDIDKKDGDLIYADDTAGWDTRITEDDLLNEELITEQMAPHHKTLAKAIFKLTYQNKVVKVLRPTPKGAVMDIISRKDQRGSGQVGTYGLNTFTNMEVQLIRQMEAEGVITQDDMQNPKGLKERVEKWLKECGVDRLKRMAISGDDCVVKPLDERFSTSLLFLNDMGKVRKDVPQWEPSKGWKNWQEVPFCSHHFHKIFMKDGRSLVVPCRNQDELIGRARISQGAGWSLRETACLGKAYAQMWSLMYFHRRDLRLASMAICSAVPTEWFPTSRTTWSIHAQHQWMTTEDMLKVWNRVWIEDNPNMTDKTPVHSWEDIPYLGKREDLWCGSLIGLSSRATWAKNIHTAITQVRNLIGKEEYVDYMPVMKRYSSPSESEGVL

SEQ ID NO: 5235 - protein, 3288 aa, Artificial Sequence
  derived and/or modified protein sequence (wt) from DENV-4__KJ160504__SS-prME
STITLLCLIPTVMAFHLSTRDGEPLMIVAKHERGRPLLFKTTEGINKCTLIAMDLGEMCEDTVTYKCPLLVNTEPEDIDCWCNLTSTWVMYGTCTQSGERRREKRSVALTPHSGMGLETRAETWMSSEGAWKHAQRVESWILRNPGFALLAGFMAYMIGQTGIQRTVFFVLMMLVAPSYGMRCVGVGNRDFVEGVSGGAWVDLVLEHGGCVTTMAQGKPTLDFELTKTTAKEVALLRTYCIEASISNITTATRCPTQGEPYLKEEQDQQYICRRDVVDRGWGNGCGLFGKGGVVTCAKFSCSGKITGNLVQIENLEYTVVVTVHNGDTHAVGNDTSNHGVTATITPRSPSVEVKLPDYGELTLDCEPRSGIDFNEMILMKMKKKTWLVHKQWFLDLPLPWTAGADTSEVHWNYKERMVTFKVPHAKRQDVTVLGSQEGAMHSALAGATEVDSGDGNHMFAGHLKCKVRMEKLRIKGMSYTMCSGKFSIDKEMAETQHGTTVVKVKYEGAGAPCKVPIEIRDVNKEKVVGRVISSTPLAENTNSVTNIELEPPFGDSYIVIGVGNSALTLHWFRKGSSIGKMFESTYRGAKRMAILGETAWDFGSVGGLFTSLGKAVHQVFGSVYTTMFGGVSWMIRILIGFLVLWIGTNSRNTSMAMTCIAVGGITLFLGFTVQADMGCVVSWSGRELKCGSGIFVVDNVHTWTEQYKFQPESPARLASAILNAHKDGVCGIRSTTRLENVMWKQITNELNYVLWEGGHDLTVVAGDVKGVLTKGKRALTPPVSDLKYSWKTWGKAKIFTPEARNSTFLIDGPDTSECPNERRAWNSLEVEDYGFGMFTTNIWMKFREGSSEVCDHRLMSAAIKDQKAVHADMGYWIESSKNQTWQIEKASLIEVKTCLWPKTHTLWSNGVLESQMLIPKSYAGPFSQHNYRQGYATQTVGPWHLGKLEIDFGECPGTTVTIQEDCDHRGPSLRTTTASGKLVTQWCCRSCTMPPLRFLGEDGCWYGMEIRPLSEKEENMVKSQVTAGQGTSETFSMGLLCLTLFVEECLRRRVTRKHMILVVVITLCAIILGGLTWMDLLRALIMLGDTMSGRIGGQIHLAIMAVFKMSPGYVLGVFLRKLTSRETALMVIGMAMTTVLSIPHDLMELIDGISLGLILLKIVTQFDNTQVGTLALSLTFIRSTMPLVMAWRTIMAVLFVVTLIPLCRTSCLQKQSHWVEITALILGAQALPVYLMTLMKGASRRSWPLNEGIMAVGLVSLLGSALLKNDVPLAGPMVAGGLLLAAYVMSGSSADLSLEKAANVQWDEMADITGSSPIIEVKQDEDGSFSIRDVEETNMITLLVKLALITVSGLYPLAIPITMTLWYMWQVKTQRSGALWDVPSPAATQKAALSEGVYRIMQRGLFGKTQVGVGIHMEGVFHTMWHVTRGSVICHETGRLEPSWADVRNDMISYGGGWRLGDKWDKEEDVQVLAIEPGKNPKHVQTKPGLFKTLTGEIGAVTLDFKPGTSGSPIINRKGKVIGLYGNGVVTKSGDYVSAITQAERIGEPDYEVDEDIFRKKRLTIMDLHPGAGKTKRILPSIVREALKRRLRTLILAPTRVVAAEMEEALRGLPIRYQTPAVKSEHTGREIVDLMCHATFTTRLLSSTRVPNYNLIVMDEAHFTDPSSVAARGYISTRVEMGEAAAIFMTATPPGATDPFPQSNSPIEDIEREIPERSWNTGFDWITDYQGKTVWFVPSIKAGNDIANCLRKSGKKVIQLSRKTFGTEYPKTKLTDWDFVVTTDISEMGANFRAGRVIDPRRCLKPVILTDGPERVILAGPIPVTPASAAQRRGRVGRNPAQEDDQYVFSGDPLKNDEDHAHWTEAKMLLDNIYTPEGIIPTLFGPEREKTQAIDGEFRLRGEQRKTFVELMRRGDLPVWLSYKVASAGISYKDREWCFTGERNNQILEENMEVEIWTREGEKKKLRPRWLDARVYADPMALKDFKEFASGRKSITLDILTEIASLPAYLSSRAKLALDNIVMLHTTERGGRAYQHALNELPESLETLMLVALLGAMTAGIFLFFMQGKGIGKLSMGLITIAVASGLLWIAEIQPQWIAASIILEFFLMVLLIPEPEKQRTPQDNQLIYVILTVLTIIGLIAANEMGLIEKTKTDFGFYQVKTETTILDVDLRPASAWTLYAVATTVLTPMLRHTIENTSANLSLAAIANQAAVLMGLGKGWPLHRMDLGVPLLAMGCYSQVNPTTLTASLVMLFVHYAIIGPGLQAKATREAQKRTAAGIMKNPTVDGITVIDLEPISYDPKFEKQLGQVMLLVLCAGQLLLMRTTWAFCEVLTLATGPILTLWEGNPGRFWNTTIAVSTANIFRGSYLAGAGLAFSLIKNAQTPRRGTGTTGETLGEKWKRQLNSLDRKEFEEYKRSGILEVDRTEAKSALKDGSKIKHAVSRGSSKIRWIVERGMVKPKGKVVDLGCGRGGWSYYMATLKNVTEVKGYTKGGPGHEEPIPMATYGWNLVKLHSGVDVFYKPTEQVDTLLCDIGESSSNPTIEEGRTLRVLKMVEPWLSSKPEFCIKVLNPYMPTVIEELEKLQRKHGGNLVRCPLSRNSTHEMYWVSGASGNIVSSVNTTSKMLLNRFTTRHRKPTYEKDVDLGAGTRSVSTETEKPDMTIIGRRLQRLQEEHKETWHYDQENPYRTWAYHGSYEAPSTGSASSMVNGVVKLLTKPWDVIPMVTQLAMTDTTPFGQQRVFKEKVDTRTPQPKPGTRMVMTTTANWLWALLGKKKNPRLCTREEFISKVRSNAAIGAVFQEEQGWTSASEAVNDSRFWELVDKERALHQEGKCESCVYNMMGKREKKLGEFGRAKGSRAIWYMWLGARFLEFEALGFLNEDHWFGRENSWSGVEGEGLHRLGYILEEIDKKDGDLMYADDTAGWDTRITEDDLQNEELITEQMAPHHKILAKAIFKLTYQNKVVKVLRPTPRGAVMDIISRKDQRGSGQVGTYGLNTFTNMEVQLIRQMEAEGVITQDDMQNPKGLKERVEKWLRECGVDRLKRMAISGDDCVVKPLDERFGTSLLFLNDMGKVRKDIPQWEPSKGWKNWQEVPFCSHHFHKIFMKDGRSLVVPCRNQDELIGRARISQGAGWSLRETACLGKAYAQMWSLMYFHRRDLRLASMAICSAVPTEWFPTSRTTWSIHAHHQWMTTEDMLKVWNRVWIEDNPNMTDKTPVHSWEDIPYLGKREDLWCGSLIGLSSRATWAKNIHTAITQVRNLIGKEEYVDYMPVMKRYSAPSESEGVL

SEQ ID NO: 5236 - protein, 3288 aa, Artificial Sequence
  derived and/or modified protein sequence (wt) from DENV-4__GU289913__SS-prME
STITLLCLIPTVMAFHLSTRDGEPLMIVAKHERGRPLLFKTTEGINKCTLIAMDLGEMCEDTVTYKCPLLVNTEPEDIDCWCNLTSTWVMYGTCTQSGERRREKRSVALTPHSGMGLETRAETWMSSEGAWKHAQRVESWILRNPGFALLAGFMAYMIGQTGIQRTVFFVLMMLVAPSYGMRCVGVGNRDFVEGVSGGAWVDLVLEHGGCVTTMAQGKPTLDFELTKTTAKEVALLRTYCIEASISNITTATRCPTQGEPYLKEEQDQQYICRRDVVDRGWGNGCGLFGKGGVVTCAKFSCSGKITGNLVQIENLEYTVVVTVHNGDTHAVGNDTSNHGVTAMITPRSPSVEVKLPDYGELTLDCEPRSGIDFNEMILMKMKKKTWLVHKQWFLDLPLPWTAGADTSEVHWNYKERMVTFKVPHAKRQDVTVLGSQEGAMHSALAGATEVDSGDGNHMFAGHLKCKVRMEKLRIKGMSYTMCSGKFSIDKEMAETQHGTTVVKVKYEGAGAPCKVPIEIRDVNKEKVVGRIISSTPLAENTNSVTNIELEPPFGDSYIVIGVGNSALTLHWFRKGSSIGKMFESTYRGAKRMAILGETAWDFGSVGGLFTSLGKAVHQVFGSVYTTMFGGVSWMIRILIGFLVLWIGTNSRNTSMAMTCIAVGGITLFLGFTVQADMGCVVSWSGKELKCGSGIFVVDNVHTWTEQYKFQPESPARLASAILNAHKDGVCGIRSTTRLENVMWKQITNELNYVLWEGGHDLTVVAGDVKGVLTKGKRALTPPVSDLKYSWKTWGKAKIFTPEARNSTFLIDGPDTSECPNERRAWNSLEVEDYGFGMFTTNIWMKFREGSSEVCDHRLMSAAIKDQKAVHADMGYWIESSKNQTWQIEKASLIEVKTCLWPKTHTLWSNGVLESQMLIPKSYAGPFSQHNYRQGYATQTVGPWHLGKLEIDFGECPGTTVTIQEDCDHRGPSLRTTTASGKLVTQWCCRSCTMPPLRFLGEDGCWYGMEIRPLSEKEENMVKSQVTAGQGTSETFSMGLLCLTLFVEECLRRRVTRKHMILVVVITLCAIILGGLTWMDLLRALIMLGDTMSGRIGGQIHLAIMAVFKMSPGYVLGVFLRKLTSRETALMVIGMAMTTVLSIPHDLMELIDGISLGLILLKIVTQFDNTQVGTLALSLTFIRSTMPLVMAWRTIMAVLFVVTLIPLCRTSCLQKQSHWVEITALILGAQALPVYLMTLMKGASRRSWPLNEGIMAVGLVSLLGSALLKNDVPLAGPMVAGGLLLAAYVMSGSSADLSLEKAANVQWDEMADITGSSPIIEVKQDEDGSFSIRDVEETNMITLLVKLALITVSGLYPLAIPVTMTLWYMWQVKTQRSGALWDVPSPAATQKAALSEGVYRIMQRGLFGKTQVGVGIHMEGVFHTMWHVTRGSVICHETGRLEPSWADVRNDMISYGGGWRLGDKWDKEEDVQVLAIEPGKNPKHVQTKPGLFKTLTGEIGAVTLDFKPGTSGSPIINRKGKVIGLYGNGVVTKSGDYVSAITQAERIGEPDYEVDEDIFRKKRLTIMDLHPGAGKTKRILPSIVREALKRRLRTLILAPTRVVAAEMEEALRGLPIRYQTPAVKSEHTGREIVDLMCHATFTTRLLSSTRVPNYNLIVMDEAHFTDPSSVAARGYISTRVEMGEAAAIFMTATPPGATDPFPQSNSPIEDIEREIPERSWNTGFDWITDYQGKTVWFVPSIKAGNDIANCLRKSGKKVIQLSRKTFDTEYPKTKLTDWDFVVTTDISEMGANFRAGRVIDPRRCLKPVILTDGPERVILAGPIPVTPASAAQRRGRIGRNPAQEDDQYVFSGDPLKNDEDHAHWTEAKMLLDNIYTPEGIIPTLFGPEREKTQAIDGEFRLRGEQRKTFVELMRRGDLPVWLSYKVASAGISYKDREWCFTGERNNQILEENMEVEIWTREGEKKKLRPRWLDARVYADPMALKDFKEFASGRKSITLDILTEIASLPTYLSSRAKLALDNIVMLHTTERGGRAYQHALNELPESLETLMLVALLGAMTAGIFLFFMQGKGIGKLSMGLITIAVASGLLWVAEIQPQWIAASIILEFFLMVLLIPEPEKQRTPQDNQLIYVILTILTIIGLIAANEMGLIEKTKTDFGFYQVKTETTILDVDLRPASAWTLYAVATTILTPMLRHTIENTSANLSLAAIANQAAVLMGLGKGWPLHRMDLGVPLLAMGCYSQVNPTTLTASLVMLSVHYAIIGPGLQAKATREAQKRTAAGIMKNPTVDGITVIDLEPISYDPKFEKQLGQVMLLVLCAGQLLLMRTTWAFCEVLTLATGPILTLWEGNPGRFWNTTIAVSTANIFRGSYLAGAGLAFSLIKNAQTPRRGTGTTGETLGEKWKRQLNSLDRKEFEEYKRSGILEVDRTEAKSALKDGSKIKHAVSRGSSKIRWIVERGMVKPKGKVVDLGCGRGGWSYYMATLKNVTEVKGYTKGGPGHEEPIPMATYGWNLVKLHSGVDVFYKPTEQVDTLLCDIGESSSNPTIEEGRTLRVLKMVEPWLSSKPEFCIKVLNPYMPTVIEELEKLQRKHGGNLVRCPLSRNSTHEMYWVSGASGNIVSSVNTTSKMLLNRFTTRHRKPTYEKDVDLGAGTRSVSTETEKPDMTIIGRRLQRLQEEHKETWHYDQENPYRTWAYHGSYEAPSTGSASSMVNGVVKLLTKPWDVIPMVTQLAMTDTTPFGQQRVFKEKVDTRTPQPKPGTRMVMTTTANWLWALLGKKKNPRLCTREEFISKVRSNAAIGAVFQEEQGWTSASEAVNDSRFWELVDKERALHQEGKCESCVYNMMGKREKKLGEFGRAKGSRAIWYMWLGARFLEFEALGFLNEDHWFGRENSWSGVEGEGLHRLGYILEEIDKKDGDLMYADDTAGWDTRITEDDLQNEELITEQMAPHHKILAKAIFKLTYQNKVVKVLRPTPRGAVMDIISRKDQRGSGQVGTYGLNTFTNMEVQLIRQMEAEGVITQDDMQNPKGLKERVEKWLKECGVDRLKRMAISGDDCVVKPLDERFGTSLLFLNDMGKVRKDIPQWEPSKGWKNWQEVPFCSHHFHKIFMKDGRSLVVPCRNQDELIGRARISQGAGWSLRETACLGKAYAQMWSLMYFHRRDLRLASMAICSAVPTEWFPTSRTTWSIHAHHQWMTTEDMLKVWNRVWIEDNPNMTDKTPVHSWEDIPYLGKREDLWCGSLIGLSSRATWAKNIHTAITQVRNLIGKEEYVDYMPVMKRYSAPSESEGVL

SEQ ID NO: 5237 - protein, 3288 aa, Artificial Sequence
  derived and/or modified protein sequence (wt) from DENV-4__KJ579243__SS-prME
STITLLCLIPTVMAFHLSTRDGEPLMIVAKHERGRPLLFKTTEGINKCTLIAMDLGEMCEDTVTYKCPLLVNTEPEDIDCWCNLTSTWVMYGTCTQSGERRREKRSVALTPHSGMGLETRAETWMSSEGAWKHAQRVESWILRNPGFALLAGFMAYMIGQTGIQRTVFFVLMMLVAPSYGMRCVGVGNRDFVEGVSGGAWVDLVLEHGGCVTTMAQGKPTLDFELTKTTAKEVALLRTYCIEALISNITTATRCPTQGEPYLKEEQDQQYICRRDVVDRGWGNGCGLFGKGGVVTCAKFSCSGKITGNLVQIENLEYTVVVTVHNGDTHAVGNDTSNHGVTATITPRSPSVEVKLPDYGELTLDCEPRSGIDFNEMILMKMKKKTWLVHKQWFLDLPLPWTTGADTSEVHWNYKERMVTFKVPHAKRQDVTVLGSQEGAMHSALAGATEVDSGDGNHMFAGHLKCKVRMEKLRIKGMSYTMCSGKFSIDKEMAETQHGTTVVKVKYEGAGAPCKVPIEIRDVNKEKVVGRVISATPLAENTNSVTNIELEPPFGDSYIVIGVGNSALTLHWFRKGSSIGKMFESTYRGAKRMAILGETAWDFGSVGGLFTSLGKAVHQVFGSVYTTMFGGVSWMIRILIGCLVLWIGTNSRNTSMAMTCIAVGGITLFLGFTVQADMGCVVSWSGRELKCGSGIFVVDNVHTWTEQYKFQPESPARLASAILNAHKDGVCGIRSTTRLENVMWKQITNELNYVLWEGGHDLTVVAGDVKGVLTKGKRALTPPASGLKYSWKTWGKAKIFTPEARNSTFLIDGPDTSECPNERRAWNSFEVEDYGFGMFTTNIWMKFREGSSEVCDHRLMSAAIKDQKAVHADMGYWIESSKNQTWQIERASLIEVKTCLWPKTHTLWSNGVLESQMLIPKSYAGPFSQHNYRQGYATQTVGPWHLGKLEIDFGECPGTTVTIQENCDHRGPSLRTTTASGKLVTQWCCRSCTMPPLRFLGEDGCWYGMEIRPLSEKEENMVKSQVTAGQGTSETFSMGLLCLTLFVEECLRRRVTRKHMILAVVITLCAIILGGLTWMDLLRALIILGDTMSGRIGGQTHLAIMAVFKMSPGYVLGVFLRKLTSRETALMVIGMAMTTTLSIPHDLMELIDGISLGLILLKIVTQFDNTQVGTLALSLTFIRSTMSLVMAWRTIMAVLFVVTLIPLCRTSCLQKQSHWVEITALILGAQALPVYLMTLMKGASRRSWPLNEGIMAVGLVSLLGSALLKNDVPLAGPMVAGGLLLAAYVMSGSSADLSLEKAANVQWDEMADITGSSPIIEVKQDEDGSFSIRDVEETNMITLLVKLALITVSGLYPLAIPITMTLWYMWQVKTQRSGALWDVPSPAATQKAALSEGVYRIMQRGLFGKTQVGVGIHMEGVFHTMWHVTRGSVICHETGRLEPSWADVRNDMISYGGGWRLGDKWDKEEDVQVLAIEPGKNPKHVQTKPGLFKTLTGEIGAVTLDFKPGTSGSPIINRKGKVIGLYGNGVVTKSGDYVSAITQAERIGEPDYEVDEDIFRKKRLTIMDLHPGAGKTKRILPSIVREALKRRLRTLILAPTRVVAAEMEEALRGLPIRYQTPAVKSEHTGREIVDLMCHATFTTRLLSSTRVPNYNLIVMDEAHFTDPSSVAARGYISTRVEMGEAAAIFMTATPPGATDPFPQSNSPIEDIEREIPERSWNTGFDWITDYQGKTVWFVPSIKAGNDIANCLRKSGKKVIQLSRKTFDTEYPKTKLTDWDFVVTTDISEMGANFRAGRVIDPRRCLKPVILTDGPERVILAGPIPVTPASAAQRRGRIGRNPAQEDDQYVFSGDPLKNDEDHAHWTEAKMLLDNIYTPEGIIPTLFGPEREKTQAIDGEFRLRGEQRKTFVELMRRGDLPVWLSYKVASAGISYKDREWCFTGERNNQILEENMEVEIWTREGEKKKLRPKWLDARVYADPMALKDFKEFASGRKSITLDILTEIASLPTYLSSRAKLALDNIVMLHTTERGGRAYQHALNELPESLETLMLVALLGAMTAGIFLFFMQGKGIGKLSMGLITIAVASGLLWVAEIQPQWIAASIILEFFLMVLLIPEPEKQRTPQDNQLIYVILTILTIIGLIAANEMGLIEKTKTDFGFYQVKTETTILDVDLRPASAWTLYAVATTILTPMLRHTIENTSANLSLAAIANQAAVLMGLGKGWPLHRMDLGVPLLAMGCYSQVNPTTLTASLVMLLVHYAIIGPGLQAKATREAQKRTAAGIMKNPTVDGITVIDLEPISYDPKFEKQLGQVMLLVLCAGQLLLMRTTWAFCEVLTLATGPILTLWEGNPGRFWNTTIAVSTANIFRGSYLAGAGLAFSLIKNAQTPRRGTGTAGETLGEKWKRQLNSLDRKEFEEYKRSGILEVDRTEAKSALKDGSKIKHAVSRGSSKIRWIVERGMVKPKGKVVDLGCGRGGWSYYMATLKNVTEVKGYTKGGPGHEEPIPMATYGWNLVKLHSGVDVFYKPTEQVDTLLCDIGESSSNPTIEEGRTLRVLKMVEPWLSSKPEFCIKVLNPYMPTVIEELEKLQRKHGGNLVRCPLSRNSTHEMYWVSGASGNIVSSVNTTSKMLLNRFTTRHRKPTYEKDVDLGAGTRSVSTETEKPDMTIIGRRLQRLQEEHKETWHYDQENPYRTWAYHGSYEAPSTGSASSMVNGVVKLLTKPWDVIPMVTQLAMTDTTPFGQQRVFKEKVDTRTPQPKPGTRMVMTTTANWLWALLGKKKNPRLCTREEFISKVRSNAAIGAVFQEEQGWTSASEAVNDSRFWELVDKERALHQEGKCESCVYNMMGKREKKLGEFGRAKGSRAIWYMWLGARFLEFEALGFLNEDHWFGRENSWSGVEGEGLHRLGYILEEIDKKDGDLMYADDTAGWDTRITEDDLQNEELITEQMAPHHKILAKAIFKLTYQNKVVKVLRPTPRGAVMDIISRKDQRGSGQVGTYGLNTFTNMEVQLIRQMEAEGVITQDDMQNPKGLKERVEKWLRECGVDRLKRMAISGDDCVVKPLDERFGTSLLFLNDMGKVRKDIPQWEPSKGWKNWQEVPFCSHHFHKIFMKDGRSLVVPCRNQDELIGRARISQGAGWSLRETACLGKAYAQMWSLMYFHRRDLRLASMAICSAVPTEWFPTSRTTWSIHAHHQWMTTEDMLKVWNRVWIEDNPNMIDKTPVHSWEDIPYLGKREDLWCGSLIGLSSRATWAKNIHTAITQVRNLIGKEEYVDYMPVMKRYSAPSESEGVL

SEQ ID NO: 5238 - protein, 3288 aa, Artificial Sequence
  derived and/or modified protein sequence (wt) from DENV-4__KJ579246__SS-prME
STITLLCLIPTVMAFHLSTRDGEPLMIVAKHERGRPLLFKTTEGINKCTLIAMDLGEMCEDTVTYKCPLLVNTEPEDIDCWCNLTSTWVMYGTCTQSGERRREKRSVALTPHSGMGLETRAETWMSSEGAWKHAQRVESWILRNPGFALLAGFMAYMIGQTGIQRTVFFVLMMLVAPSYGMRCVGVGNRDFVEGVSGGAWVDLVLEHGGCVTTMAQGKPTLDFELTKTTAKEVALLRTYCIEALISNITTATRCPTQGEPYLKEEQDQQYICRRDVVDRGWGNGCGLFGKGGVVTCAKFSCSGKITGNLVQIENLEYTVVVTVHNGDTHAVGNDTSNHGVTATITPRSPSVEVKLPDYGELTLDCEPRSGIDFNEMILMKMKKKTWLVHKQWFLDLPLPWTTGADTSEVHWNYKERMVTFKVPHAKRQDVTVLGSQEGAMHSALAGATEVDSGDGNHMFAGHLKCKVRMEKLRIKGMSYTMCSGKFSIDKEMAETQHGTTVVKVKYEGAGAPCKVPIEIRDVNKEKVVGRVISATPLAENTNSVTNIELEPPFGDSYIVIGVGNSALTLHWFRKGSSIGKMFESTYRGAKRMAILGETAWDFGSVGGLFTSLGKAVHQVFGSVYTTMFGGVSWMIRILIGFLVLWIGTNSRNTSMAMTCIAVGGITLFLGFTVQADMGCVVSWSGRELKCGSGIFVVDNVHTWTEQYKFQPESPARLASAILNAHKDGVCGIRSTTRLENVMWKQITNELNYVLWEGGHDLTVVAGDVKGVLTKGKRALTPPASDLKYSWKTWGKAKIFTPEARNSTFLIDGPDTSECPNERRAWNSFEVEDYGFGMFTTNIWMKFREGSSEVCDHRLMSAAIKDQKAVHADMGYWIESSKNQTWQIERASLIEVKTCLWPKTHTLWSNGVLESQMLIPKSYAGPFSQHNYRQGYATQTVGPWHLGKLEIDFGECPGTTVTIQENCDHRGPSLRTTTASGKLVTQWCCRSCTMPPLRFLGEDGCWYGMEIRPLSEKEENMVKSQVTAGQGTSETFSMGLLCLTLFVEECLRRRVTRKHMILAVVITLCAIILGGLTWMDLLRALIILGDTMSGRIGGQTHLAIMAVFKMSPGYVLGVFLRKLTSRETALMVIGMAMTTTLSIPHDLMELIDGISLGLILLKIVTQFDNTQVGTLALSLTFIRSTMSLVMAWRTIMAVLFVVTLIPLCRTSCLQKQSHWVEITALILGAQALPVYLMTLMKGASRRSWPLNEGIMAVGLVSLLGSALLKNDVPLAGPMVAGGLLLAAYVMSGSSADLSLEKAANVQWDEMADITGSSPIIEVKQDEDGSFSIRDVEETNMITLLVKLALITVSGLYPLAIPITMTLWYMWQVKTQRSGALWDVPSPAATQKAALSEGVYRIMQRGLFGKTQVGVGIHMEGVFHTMWHVTRGSVICHETGRLEPSWADVRNDMISYGGGWRLGDKWDKEEDVQVLAIEPGKNPKHVQTKPGLFKTLTGEIGAVTLDFKPGTSGSPIINRKGKVIGLYGNGVVTKSGDYVSAITQAERIGEPDYEVDEDIFRKKRLTIMDLHPGAGKTKRILPSIVREALKRRLRTLILAPTRVVAAEMEEALRGLPIRYQTPAVKSEHTGREIVDLMCHATFTTRLLSSTRVPNYNLIVMDEAHFTDPSSVAARGYISTRVEMGEAAAIFMTATPPGATDPFPQSNSPIEDIEREIPERSWNTGFDWITDYQGKTVWFVPSIKAGNDIANCLRKSGKKVIQLSRKTFDTEYPKTKLTDWDFVVTTDISEMGANFRAGRVIDPRRCLKPVILTDGPERVILAGPIPVTPASAAQRRGRIGRNPAQEDDQYVFSGDPLKNDEDHAHWTEAKMLLDNIYTPEGIIPTLFGPEREKTQAIDGEFRLRGEQRKTFVELMRRGDLPVWLSYKVASAGISYKDREWCFTGERNNQILEENMEVEIWTREGEKKKLRPKWLDARVYADPMALKDFKEFASGRKSITLDILTEIASLPTYLSSRAKLALDNIVMLHTTERGGRAYQHALNELPESLETLMLVALLGAMTAGIFLFFMQGKGIGKLSMGLITIAVASGLLWVAEIQPQWIAASIILEFFLMVLLIPEPEKQRTPQDNQLIYVILTILTIIGLIAANEMGLIEKTKTDFGFYQVKTETTILDVDLRPASAWTLYAVATTILTPMLRHTIENTSANLSLAAIANQAAVLMGLGKGWPLHRMDLGVPLLAMGCYSQVNPTTLTASLVMLLVHYAIIGPGLQAKATREAQKRTAAGIMKNPTVDGITVIDLEPISYDPKFEKQLGQVMLLVLCAGQLLLMRTTWAFCEVLTLATGPILTLWEGNPGRFWNTTIAVSTANIFRGSYLAGAGLAFSLIKNAQTPRRGTGTAGETLGEKWKRQLNSLDRKEFEEYKRSGILEVDRTEAKSALKDGSKIKHAVSRGSSKIRWIVERGMVKPKGKVVDLGCGRGGWSYYMATLKNVTEVKGYTKGGPGHEEPIPMATYGWNLVKLHSGVDVFYKPTEQVDTLLCDIGESSSNPTIEEGRTLRVLKMVEPWLSSKPEFCIKVLNPYMPTVIEELEKLQRKHGGNLVRCPLSRNSTHEMYWVSGASGNIVSSVNTTSKMLLNRFTTRHRKPTYEKDVDLGAGTRSVSTETEKPDMTIIGRRLQRLQEEHKETWHYDQENPYRTWAYHGSYEAPSTGSASSMVNGVVKLLTKPWDVIPMVTQLAMTDTTPFGQQRVFKEKVDTRTPQPKPGTRMVMTTTANWLWALLGKKKNPRLCTREEFISKVRSNAAIGAVFQEEQGWTSASEAVNDSRFWELVDKERALHQEGKCESCVYNMMGKREKKLGEFGRAKGSRAIWYMWLGARFLEFEALGFLNEDHWFGRENSWSGVEGEGLHRLGYILEEIDKKDGDLMYADDTAGWDTRITEDDLQNEELITEQMAPHHKILAKAIFKLTYQNKVVKVLRPTPRGAVMDIISRKDQRGSGQVGTYGLNTFTNMEVQLIRQMEAEGVITQDDMQNPKGLKERVEKWLRECGVDRLKRMAISGDDCVVKPLDERFGTSLLFLNDMGKVRKDIPQWEPSKGWKNWQEVPFCSHHFHKIFMKDGRSLVVPCRNQDELIGRARISQGAGWSLRETACLGKAYAQMWSLMYFHRRDLRLASMAICSAVPTEWFPTSRTTWSIHAHHQWMTTEDMLKVWNRVWIEDNPNMIDKTPIHSWEDIPYLGKREDLWCGSLIGLSSRATWAKNIHTAITQVRNLIGKEEYVDYMPVMKRYSAPSESEGVL

SEQ ID NO: 5239 - protein, 3288 aa, Artificial Sequence
  derived and/or modified protein sequence (wt) from DENV-4__KJ579248__SS-prME
STITLLCLIPTVMAFHLSTRDGEPLMIVAKHERGRPLLFKTTEGINKCTLIAMDLGEMCEDTVTYKCPLLVNTEPEDIDCWCNLTSTWVMYGTCTQSGERRREKRSVALTPHSGMGLETRAETWMSSEGAWKHAQRVESWILRNPGFALLAGFMAYMIGQTGIQRTVFFVLMMLVAPSYGMRCVGVGNRDFVEGVSGGAWVDLVLEHGGCVTTMAQGKPTLDFELTKTTAKEVALLRTYCIEALISNITTATRCPTQGEPYLKEEQDQQYICRRDVVDRGWGNGCGLFGKGGVVTCAKFSCSGKITGNLVQIENLEYTVVVTVHNGDTHAVGNDTSNHGVTATITPRSPSVEVKLPDYGELTLDCEPRSGIDFNEMILMKMKKKTWLVHKQWFLDLPLPWTTGADTSEVHWNYKERMVTFKVPHAKRQDVTVLGSQEGAMHSALAGATEVDSGDGNHMFAGHLKCKVRMEKLRIKGMSYTMCSGKFSIDKEMAETQHGTTVVKVKYEGAGAPCKVPIEIRDVNKEKVVGRVISATPLAENTNSVTNIELEPPFGDSYIVIGVGNSALTLHWFRKGSSIGKMFESTYRGAKRMAILGETAWDFGSVGGLFTSLGKAVHQVFGSVYTTMFGGVSWMIRILIGFLVLWIGTNSRNTSMAMTCIAVGGITLFLGFTVQADMGCVVSWSGRELKCGSGIFVVDNVHTWTEQYKFQPESPARLASAILNAHKDGVCGIRSTTRLENVMWKQITNELNYVLWEGGHDLTVVAGDVKGVLTKGKRALTPPASDLKYSWKTWGKAKIFTPEARNSTFLIDGPDTSECPNERRAWNSFEVEDYGFGMFTTNIWMKFREGSSEVCDHRLMSAAIKDQKAVHADMGYWIESSKNQTWQIERASLIEVKTCLWPKTHTLWSNGVLESQMLIPKSYAGPFSQHNYRQGYATQTVGPWHLGKLEIDFGECPGTTVTIQENCDHRGPSLRTTTASGKLVTQWCCRSCTMPPLRFLGEDGCWYGMEIRPLSEKEENMVKSQVTAGQGTSETFSMGLLCLTLFVEECLRRRVTRKHMILAVVITLCAIILGGLTWMDLLRALIMLGDTMSGRVGGQTHLAIIAVFKMSPGYVLGVFLRKLTSRETALMVIGMAMTTTLSIPHDLMELIDGISLGLILLKIVTQFDNTQVGTLALSLTFIRSTMSLVMAWRTIMAVLFVVTLIPLCRTSCLQKQSHWVEITALILGAQALPVYLMTLMKGASRRSWPLNEGIMAVGLVSLLGSALLKNDVPLAGPMVAGGLLLAAYVMSGSSADLSLEKAANVQWDEMADITGSSPIIEVKQDEDGSFSIRDVEETNMITLLVKLALITVSGLYPLAIPITMTLWYMWQVKTQRSGALWDVPSPAATQKAALSEGVYRIMQRGLFGKTQVGVGIHMEGVFHTMWHVTRGSVICHETGRLEPSWADVRNDMISYGGGWRLGDKWDKEEDVQVLAIEPGKNPKHVQTKPGLFKTLTGEIGAVTLDFKPGTSGSPIINRKGKVIGLYGNGVVTKSGDYVSAITQAERIGEPDYEVDEDIFRKKRLTIMDLHPGAGKTKRILPSIVREALKRRLRTLILAPTRVVAAEMEEALRGLPIRYQTPAVKSEHTGREIVDLMCHATFTTRLLSSTRVPNYNLIVMDEAHFTDPSSVAARGYISTRVEMGEAAAIFMTATPPGATDPFPQSNSPIEDIEREIPERSWNTGFDWITDYQGKTVWFVPSIKAGNDIANCLRKSGKKVIQLSRKTFDTEYPKTKLTDWDFVVTTDISEMGANFRAGRVIDPRRCLKPVILTDGPERVILAGPIPVTPASAAQRRGRIGRNPAQEDDQYVFSGDPLKNDEDHAHWTEAKMLLDNIYTPEGIIPTLFGPEREKTQAIDGEFRLRGEQRKTFVELMRRGDLPVWLSYKVASAGISYKDREWCFTGERNNQILEENMEVEIWTREGEKKKLRPKWLDARVYADPMALKDFKEFASGRKSITLDILTEIASLPTYLSSRAKLALDNIVMLHTTERGGRAYQHALNELPESLETLMLVALLGAMTAGIFLFFMQGKGIGKLSMGLITIAVASGLLWVAEIQPQWIAASIILEFFLMVLLIPEPEKQRTPQDNQLIYVILTILTIIGLIAANEMGLIEKTKTDFGFYQVKTETTILDVDLRPASAWTLYAVATTILTPMLRHTIENTSANLSLAAIANQAAVLMGLGKGWPLHRMDLGVPLLAMGCYSQVNPTTLTASLVMLLVHYAIIGPGLQAKATREAQKRTAAGIMKNPTVDGITVIDLEPISYDPKFEKQLGQVMLLVLCAGQLLLMRTTWAFCEVLTLATGPILTLWEGNPGRFWNTTIAVSTANIFRGSYLAGAGLAFSLIKNAQTPRRGTGTAGETLGEKWKRQLNSLDRKEFEEYKRSGILEVDRTEAKSALKDGSKIKHAVSRGSSKIRWIVERGMVKPKGKVVDLGCGRGGWSYYMATLKNVTEVKGYTKGGPGHEEPIPMATYGWNLVKLHSGVDVFYKPTEQVDTLLCDIGESSSNPTIEEGRTLRVLKMVEPWLSSKPEFCIKVLNPYMPTVIEELEKLQRKHGGNLVRCPLSRNSTHEMYWVSGASGNIVSSVNTTSKMLLNRFTTRHRKPTYEKDVDLGAGTRSVSTEIEKPDMTIIGRRLQRLQEEHKETWHYDQENPYRTWAYHGSYEAPSTGSASSMVNGVVKLLTKPWDVIPMVTQLAMTDTTPFGQQRVFKEKVDTRTPQPKPGTRMVMTTTANWLWALLGKKKNPRLCTREEFISKVRSNAAIGAVFQEEQGWTSASEAVNDSRFWELVDKERALHQEGKCESCVYNMMGKREKKLGEFGRAKGSRAIWYMWLGARFLEFEALGFLNEDHWFGRENSWSGVEGEGLHRLGYILEEIDKKDGDLMYADDTAGWDTRITEDDLQNEELITEQMAPHHKILAKAIFKLTYQNKVVKVLRPTPRGAVMDIISRKDQRGSGQVGTYGLNTFTNMEVQLIRQMEAEGVITQDDMQNPKGLKERVEKWLRECGVDRLKRMAISGDDCVVKPLDERFGTSLLFLNDMGKVRKDIPQWEPSKGWKNWQEVPFCSHHFHKIFMKDGRSLVVPCRNQDELIGRARISQGAGWSLRETACLGKAYAQMWSLMYFHRRDLRLASMAICSAVPTEWFPTSRTTWSIHAHHQWMTTEDMLKVWNRVWIEDNPNMIDKTPVHSWEDIPYLGKREDLWCGSLIGLSSRATWAKNIHTAITQVRNLIGKEEYVDYMSVMKRYSAPSESEGVL

SEQ ID NO: 5240 - protein, 3288 aa, Artificial Sequence
  derived and/or modified protein sequence (wt) from DENV-4__KJ579240__SS-prME
STITLLCLIPTVMAFHLSTRDGEPLMIVAKHERGRPLLFKTTEGINKCTLIAMDLGEMCEDTVTYKCPLLVNTEPEDIDCWCNLTSTWVMYGTCTQSGERRREKRSVALTPHSGMGLETRAETWMSSEGAWKHAQRVESWILRNPGFALLAGFMAYMIGQTGIQRTVFFVLMMLVAPSYGMRCVGVGNRDFVEGVSGGAWVDLVLEHGGCVTTMAQGKPTLDFELTKTTAKEVALLRTYCIEALISNITTATRCPTQGEPYLKEEQDQQYICRRDVVDRGWGNGCGLFGKGGVVTCAKFSCSGKITGNLVQIENLEYTVVVTVHNGDTHAVGNDTSNHGVTATITPRSPSVEVKLPDYGELTLDCEPRSGIDFNEMILMKMKKKTWLVHKQWFLDLPLPWTTGADTSEVHWNYKERMVTFKVPHAKRQDVTVLGSQEGAMHSALAGATEVDSGDGNHMFAGHLKCKVRMEKLRIKGMSYTMCSGKFSIDKEMAETQHGTTVVKVKYEGAGAPCKVPIEIRDVNKEKVVGRVISATPLAENTNSVTNIELEPPFGDSYIVIGVGNSALTLHWFRKGSSIGKMFESTYRGAKRMAILGETAWDFGSVGGLFTSLGKAVHQVFGSVYTTMFGGVSWMIRILIGFLVLWIGTNSRNTSMAVTCIAVGGITLFLGFTVQADMGCVVSWSGRELKCGSGIFVVDNVHTWTEQYKFQPESPARLASAILNAHKDGVCGIRSTTRLENVMWKQITNELNYVLWEGGHDLTVVAGDVKGVLTKGKRALTPPASDLKYSWKTWGKAKIFTPEARNSTFLIDGPDTSECPNERRAWNSFEVEDYGFGMFTTNIWMKFREGSSEVCDHRLMSAAIKDQKAVHADMGYWIESSKNQTWQIERASLIEVKTCLWPKTHTLWSNGVLESQMLIPKSYAGPFSQHNYRQGYATQTVGPWHLGKLEIDFGECPGTTVTIQENCDHRGPSLRTTTASGKLVTQWCCRSCTMPPLRFLGEDGCWYGMEIRPLSEKEENMVKSQVTAGQGTSETFSMGLLCLTLFVEECLRRRVTRKHMILAVVITLCAIILGGLTWMDLLRALIMLGDTMSGRIGGQTHLAIIAVFKMSPGYVLGVFLRKLTSRETALMVIGMAMTTTLSIPHDLMELIDGISLGLILLKIVTQFDNTQVGTLALSLTFIRSTMSLVMAWRTIMAVLFVVTLIPLCRTSCLQKQSHWVEITALILGAQALPVYLMTLMKGASRRSWPLNEGIMAVGLVSLLGSALLKNDVPLAGPMVAGGLLLAAYVMSGSSADLSLEKAANVQWDEMADITGSSPIIEVKQDEDGSFSIRDVEETNMITLLVKLALITVSGLYPLAIPITMTLWYMWQVKTQRSGALWDVPSPAATQKAALSEGVYRIMQRGLFGKTQVGVGIHMEGVFHTMWHVTRGSVICHETGRLEPSWADVRNDMISYGGGWRLGDKWDKEEDVQVLAIEPGKNPKHVQTKPGLFKTLTGEIGAVTLDFKPGTSGSPIINRKGKVIGLYGNGVVTKSGDYVSAITQAERIGEPDYEVDEDIFRKKRLTIMDLHPGAGKTKRILPSIVREALKRRLRTLILAPTRVVAAEMEEALRGLPIRYQTPAVKSEHTGREIVDLMCHATFTTRLLSSTRVPNYNLIVMDEAHFTDPSSVAARGYISTRVEMGEAAAIFMTATPPGATDPFPQSNSPIEDIEREIPERSWNTGFDWITDYQGKTVWFVPSIKAGNDIANCLRKSGKKVIQLSRKTFDTEYPKTKLTDWDFVVTTDISEMGANFRAGRVIDPRRCLKPVILTDGPERVILAGPIPVTPASAAQRRGRIGRNPAQEDDQYVFSGDPLKNDEDHAHWTEAKMLLDNIYTPEGIIPTLFGPEREKTQAIDGEFRLRGEQRKTFVELMRRGDLPVWLSYKVASAGISYKDREWCFTGERNNQILEENMEVEIWTREGEKKKLRPKWLDARVYADPMALKDFKEFASGRKSITLDILTEIASLPTYLSSRAKLALDNIVMLHTTERGGRAYQHALNELPESLETLMLVALLGAMTAGIFLFFMQGKGIGKLSMGLITIAVASGLLWVAEIQPQWIAASIILEFFLMVLLIPEPEKQRTPQDNQLIYVILTILTIIGLIAANEMGLIEKTKTDFGFYQVKTETTILDVDLRPASAWTLYAVATTILTPMLRHTIENTSANLSLAAIANQAAVLMGLGKGWPLHRMDLGVPLLAMGCYSQVNPTTLTASLVMLLVHYAIIGPGLQAKATREAQKRTAAGIMKNPTVDGITVIDLEPISYDPKFEKQLGQVMLLVLCAGQLLLMRTTWAFCEVLTLATGPILTLWEGNPGRFWNTTIAVSTANIFRGSYLAGAGLAFSLIKNAQTPRRGTGTAGETLGEKWKRQLNSLDRKEFEEYKRSGILEVDRTEAKSALKDGSKIKHAVSRGSSKIRWIVERGMVKPKGKVVDLGCGRGGWSYYMATLKNVTEVKGYTKGGPGHEEPIPMATYGWNLVKLHSGVDVFYKPTEQVDTLLCDIGESSSNPTIEEGRTLRVLKMVEPWLSSKPEFCIKVLNPYMPTVIEELEKLQRKHGGNLVRCPLSRNSTHEMYWVSGASGNIVSSVNTTSKMLLNRFTTRHRKPTYEKDVDLGAGTRSVSTEIEKPDMTIIGRRLQRLQEEHKETWHYDQENPYRTWAYHGSYEAPSTGSASSMVNGVVKLLTKPWDVIPMVTQLAMTDTTPFGQQRVFKEKVDTRTPQPKPGTRMVMTTTANWLWALLGKKKNPRLCTREEFISKVRSNAAIGAVFQEEQGWTSASEAVNDSRFWELVDKERALHQEGKCESCVYNMMGKREKKLGEFGRAKGSRAIWYMWLGARFLEFEALGFLNEDHWFGRENSWSGVEGEGLHRLGYILEEIDKKDGDLMYADDTAGWDTRITEDDLQNEELITEQMAPHHKILAKAIFKLTYQNKVVKVLRPTPRGAVMDIISRKDQRGSGQVGTYGLNTFTNMEVQLIRQMEAEGVITQDDMQNPKGLKERVEKWLRECGVDRLKRMAISGDDCVVKPLDERFGTSLLFLNDMGKVRKDIPQWEPSKGWKNWQEVPFCSHHFHKIFMKDGRSLVVPCRNQDELIGRARISQGAGWSLRETACLGKAYAQMWSLMYFHRRDLRLASMAICSAVPTEWFPTSRTTWSIHAHHQWMTTEDMLKVWNRVWIEDNPNMIDKTPVHSWEDIPYLGKREDLWCGSLIGLSSRATWAKNIHTAITQVRNLIGKEEYVDYMSVMKRYSAPSESEGVL

SEQ ID NO: 5241 - protein, 3288 aa, Artificial Sequence
  derived and/or modified protein sequence (wt) from DENV-4__KJ596658__SS-prME
STITLLCLIPTVMAFHLSTRDGEPLMIVAKHERGRPLLFKTTEGINKCTLIAMDLGEMCEDTVTYKCPLLVNTEPEDIDCWCNLTSTWVMYGTCTQSGERRREKRSVALTPHSGMGLETRAETWMSSEGAWKHAQRVESWILRNPGFALLAGFMAYMIGQTGIQRTVFFVLMMLVAPSYGMRCVGVGNRDFVEGVSGGAWVDLVLEHGGCVTTMAQGKPTLDFELTKTTAKEVALLRTYCIEALISNITTATRCPTQGEPYLKEEQDQQYICRRDVVDRGWGNGCGLFGKGGVVTCAKFSCSGKITGNLVQIENLEYTVVVTVHNGDTHAVGNDTSNHGVTATITPRSPSVEVKLPDYGELTLDCEPRSGIDFNEMILMKMKKKTWLVHKQWFLDLPLPWTTGADTSEVHWNYKERMVTFKVPHAKRQDVTVLGSQEGAMHSALAGATEVDSGDGNHMFAGHLKCKVRMEKLRIKGMSYTMCSGKFSIDKEMAETQHGTTVVKVKYEGAGAPCKVPIEIRDVNKEKVVGRVISATPLAENTNSVTNIELEPPFGDSYIVIGVGNSALTLHWFRKGSSIGKMFESTYRGAKRMAILGETAWDFGSVGGLFTSLGKAVHQVFGSVYTTMFGGVSWMIRILIGFLVLWIGTNSRNTSMAMTCIAVGGITLFLGFTVQADMGCVVSWSGRELKCGSGIFVVDNVHTWTEQYKFQPESPARLASAILNAHKDGVCGIRSTTRLENVMWKQITNELNYVLWEGGHDLTVVAGDVKGVLTKGKRALTPPASDLKYSWKTWGKAKIFTPEARNSTFLIDGPDTSECPNERRAWNSFEVEDYGFGMFTTNIWMKFREGSSEVCDHRLMSAAIKDQKAVHADMGYWIESSKNQTWQIERASLIEVKTCLWPKTHTLWSNGVLESQMLIPKSYAGPFSQHNYRQGYATQTVGPWHLGKLEIDFGECPGTTVTIQENCDHRGPSLRTTTASGKLVTQWCCRSCTMPPLRFLGEDGCWYGMEIRPLSEKEENMVKSQVTAGQGTSETFSMGLLCLTLFVEECLRRRVTRKHMILAVVITLCAIILGGLTWMDLLRALIILGDTMSGRIGGQTHLAIMAVFKMSPGYVLGVFLRKLTSRETALMVIGMAMTTTLSIPHDLMELIDGISLGLILLKIVTQFDNTQVGTLALSLTFIRSTMSLVMAWRTIMAVLFVVTLIPLCRTSCLQKQSHWVEITALILGAQALPVYLMTLMKGASRRSWPLNEGIMAVGLVSLLGSALLKNDVPLAGPMVAGGLLLAAYVMSGSSADLSLEKAANVQWDEMADITGSSPIIEVKQDEDGSFSIRDVEETNMITLLVKLALITVSGLYPLAIPITMTLWYMWQVKTQRSGALWDVPSPAATQKAALSEGVYRIMQRGLFGKTQVGVGIHMEGVFHTMWHVTRGSVICHETGRLEPSWADVRNDMISYGGGWRLGDKWDKEEDVQVLAIEPGKNPKHVQTKPGLFKTLTGEIGAVTLDFKPGTSGSPIINRKGKVIGLYGNGVVTKSGDYVSAITQAERIGEPDYEVDEDIFRKKRLTIMDLHPGAGKTKRILPSIVREALKRRLRTLILAPTRVVAAEMEEALRGLPIRYQTPAVKSEHTGREIVDLMCHATFTTRLLSSTRVPNYNLIVMDEAHFTDPSSVAARGYISTRVEMGEAAAIFMTATPPGATDPFPQSNSPIEDIEREIPERSWNTGFDWITDYQGKTVWFVPSIKAGNDIANCLRKSGKKVIQLSRKTFDTEYPKTKLTDWDFVVTTDISEMGANFRAGRVIDPRRCLKPVILTDGPERVILAGPIPVTPASAAQRRGRIGRNPAQEDDQYVFSGDPLKNDEDHAHWTEAKMLLDNIYTPEGIIPTLFGPEREKTQAIDGEFRLRGEQRKTFVELMRRGDLPVWLSYKVASAGISYKDREWCFTGERNNQILEENMEVEIWTREGEKKKLRPKWLDARVYADPMALKDFKEFASGRKSITLDILTEIASLPTYLSSRAKLALDNIVMLHTTERGGRAYQHALNELPESLETLMLVALLGAMTAGIFLFFMQGKGIGKLSMGLITIAVASGLLWVAEIQPQWIAASIILEFFLMVLLIPEPEKQRTPQDNQLIYVILTILTIIGLIAANEMGLIEKTKTDFGFYQVKTETTILDVDLRPASAWTLYAVATTILTPMLRHTIENTSANLSLAAIANQAAVLMGLGKGWPLHRMDLGVPLLAMGCYSQVNPTTLTASLVMLLVHYAIIGPGLQAKATREAQKRTAAGIMKNPTVDGITVIDLEPISYDPKFEKQLGQVMLLVLCAGQLLLMRTTWAFCEVLTLATGPILTLWEGNPGRFWNTTIAVSTANIFRGSYLAGAGLAFSLIKNAQTPRRGTGTAGETLGEKWKRQLNSLDRKEFEEYKRSGILEVDRTEAKSALKDGSKIKHAVSRGSSKIRWIVERGMVKPKGKVVDLGCGRGGWSYYMATLKNVTEVKGYTKGGPGHEEPIPMATYGWNLVKLHSGVDVFYKPTEQVDTLLCDIGESSSNPTIEEGRTLRVLKMVEPWLSSKPEFCIKVLNPYMPTVIEELEKLQRKHGGNLVRCPLSRNSTHEMYWVSGASGNIVSSVNTTSKMLLNRFTTRHRKPTYEKDVDLGAGTRSVSTETEKPDMTIIGRRLQRLQEEHKETWHYDQENPYRTWAYHGSYEAPSTGSASSMVNGVVKLLTKPWDVIPMVTQLAMTDTTPFGQQRVFKEKVDTRTPQPKPGTRMVMTTTANWLWALLGKKKNPRLCTREEFISKVRSNAAIGAVFQEEQGWTSASEAVNDSRFWELVDKERALHQEGKCESCVYNMMGKREKKLGEFGRAKGSRAIWYMWLGARFLEFEALGFLNEDHWFGRENSWSGVEGEGLHRLGYILEEIDKKDGDLMYADDTAGWDTRITEDDLQNEELITEQMAPHHKILAKAIFKLTYQNKVVKVLRPTPRGAVMDIISRKDQRGSGQVGTYGLNTFTNMEVQLIRQMEAEGVITQDDMQNPKGLKERVEKWLRECGVDRLKRMAISGDDCVVKPLDERFGTSLLFLNDMGKVRKDIPQWEPSKGWKNWQEVPFCSHHFHKIFMKDGRSLVVPCRNQDELIGRARISQGAGWSLRETACLGKAYAQMWSLMYFHRRDLRLASMAICSAVPTEWFPTSRTTWSIHAHHQWMTTEDMLKVWNRVWIEDNPNMIDKTPVHSWEDIPYLGKREDLWCGSLIGLSSRATWAKNIHTAITQVRNLIGKEEYVDYMPVMKRYSAPSESEGVL

SEQ ID NO: 5242 - protein, 3288 aa, Artificial Sequence
  derived and/or modified protein sequence (wt) from DENV-4__KJ596659__SS-prME
STITLLCLIPTVMAFHLSTRDGEPLMIVAKHERGRPLLFKTTEGINKCTLIAMDLGEMCEDTVTYKCPLLVNTEPEDIDCWCNLTSTWVMYGTCTQSGERRREKRSVALTPHSGMGLETRAETWMSSEGAWKHAQRVESWILRNPGFALLAGFMAYMIGQTGIQRTVFFVLMMLVAPSYGMRCVGVGNRDFVEGVSGGAWVDLVLEHGGCVTTMAQGKPTLDFELTKTTAKEVALLRTYCIEALISNITTATRCPTQGEPYLKEEQDQQYICRRDVVDRGWGNGCGLFGKGGVVTCAKFSCSGKITGNLVQIENLEYTVVVTVHNGDTHAVGNDTSNHGVTATITPRSPSVEVKLPDYGELTLDCEPRSGIDFNEMILMKMKKKTWLVHKQWFLDLPLPWTTGADTSEVHWNHKERMVTFKVPHAKRQDVTVLGSQEGAMHSALAGATEVDSGDGNHMFAGHLKCKVRMEKLRIKGMSYTMCSGKFSIDKEMAETQHGTTVVKVKYEGAGAPCKVPIEIRDVNKEKVVGRVISATPLAENTNSVTNIELEPPFGDSYIVIGVGNSALTLHWFRKGSSIGKMFESTYRGAKRMAILGETAWDFGSVGGLFTSLGKAVHQVFGSVYTTMFGGVSWMIRILIGFLVLWIGTNSRNTSMAMTCIAVGGITLFLGFTVQADMGCVVSWSGRELKCGSGIFVVDNVHTWTEQYKFQPESPARLASAILNAHKDGVCGIRSTTRLENVMWKQITNELNYVLWEGGHDLTVVAGDVKGVLTKGKRALTPPASDLKYSWKTWGKAKIFTPEARNSTFLIDGPDTSECPNERRAWNSFEVEDYGFGMFTTNIWMKFREGSSEVCDHRLMSAAIKDQKAVHADMGYWIESSKNQTWQIERASLIEVKTCLWPKTHTLWSNGVLESQMLIPKSYAGPFSQHNYRQGYATQTVGPWHLGKLEIDFGECPGTTVTIQENCDHRGPSLRTTTASGKLVTQWCCRSCTMPPLRFLGEDGCWYGMEIRPLSEKEENMVKSQVTAGQGTSETFSMGLLCLTLFVEECLRRRVTRKHMILAVVITLCAIILGGLTWMDLLRALIILGDTMSGRIGGQTHLAIMAVFKMSPGYVLGVFLRKLTSRETALMVIGMAMTTTLSIPHDLMELIDGISLGLILLKIVTQFDNTQVGTLALSLTFIRSTMSLVMAWRTIMAVLFVVTLIPLCRTSCLQKQSHWVEITALILGAQALPVYLMTLMKGASRRSWPLNEGIMAVGLVSLLGSALLKNDVPLAGPMVAGGLLLAAYVMSGSSADLSLEKAANVQWDEMADITGSSPIIEVKQDEDGSFSIRDVEETNMITLLVKLALITVSGLYPLAIPITMTLWYMWQVKTQRSGALWDVPSPAATQKAALSEGVYRIMQRGLFGKTQVGVGIHMEGVFHTMWHVTRGSVICHETGRLEPSWADVRNDMISYGGGWRLGDKWDKEEDVQVLAIEPGKNPKHVQTKPGLFKTLTGEIGAVTLDFKPGTSGSPIINRKGKVIGLYGNGVVTKSGDYVSAITQAERIGEPDYEVDEDIFRKKRLTIMDLHPGAGKTKRILPSIVREALKRRLRTLILAPTRVVAAEMEEALRGLPIRYQTPAVKSEHTGREIVDLMCHATFTTRLLSSTRVPNYNLIVMDEAHFTDPSSVAARGYISTRVEMGEAAAIFMTATPPGATDPFPQSNSPIEDIEREIPERSWNTGFDWITDYQGKTVWFVPSIKAGNDIANCLRKSGKKVIQLSRKTFDTEYPKTKLTDWDFVVTTDISEMGANFRAGRVIDPRRCLKPVILTDGPERVILAGPIPVTPASAAQRRGRIGRNPAQEDDQYVFSGDPLKNDEDHAHWTEAKMLLDNIYTPEGIIPTLFGPEREKTQAIDGEFRLRGEQRKTFVELMRRGDLPVWLSYKVASAGISYKDREWCFTGERNNQILEENMEVEIWTREGEKKKLRPKWLDARVYADPMALKDFKEFASGRKSITLDILTEIASLPTYLSSRAKLALDNIVMLHTTERGGRAYQHALNELPESLETLMLVALLGAMTAGIFLFFMQGKGIGKLSMGLITIAVASGLLWVAEIQPQWIAASIILEFFLMVLLIPEPEKQRTPQDNQLIYVILTILTIIGLIAANEMGLIEKTKTDFGFYQVKTETTILDVDLRPASAWTLYAVATTILTPMLRHTIENTSANLSLAAIANQAAVLMGLGKGWPLHRMDLGVPLLAMGCYSQVNPTTLTASLVMLLVHYAIIGPGLQAKATREAQKRTAAGIMKNPTVDGITVIDLEPISYDPKFEKQLGQVMLLVLCAGQLLLMRTTWAFCEVLTLATGPILTLWEGNPGRFWNTTIAVSTANIFRGSYLAGAGLAFSLIKNAQTPRRGTGTAGETLGEKWKRQLNSLDRKEFEEYKRSGILEVDRTEAKSALKDGSKIKHAVSRGSSKIRWIVERGMVKPKGKVVDLGCGRGGWSYYMATLKNVTEVKGYTKGGPGHEEPIPMATYGWNLVKLHSGVDVFYKPTEQVDTLLCDIGESSSNPTIEEGRTLRVLKMVEPWLSSKPEFCIKVLNPYMPTVIEELEKLQRKHGGNLVRCPLSRNSTHEMYWVSGASGNIVSSVNTTSKMLLNRFTTRHRKPTYEKDVDLGAGTRSVSTETEKPDMTIIGRRLQRLQEEHKETWHYDQENPYRTWAYHGSYEAPSTGSASSMVNGVVKLLTKPWDVIPMVTQLAMTDTTPFGQQRVFKEKVDTRTPQPKPGTRMVMTTTANWLWALLGKKKNPRLCTREEFISKVRSNAAIGAVFQEEQGWTSASEAVNDSRFWELVDKERALHQEGKCESCVYNMMGKREKKLGEFGRAKGSRAIWYMWLGARFLEFEALGFLNEDHWFGRENSWSGVEGEGLHRLGYILEEIDKKDGDLMYADDTAGWDTRITEDDLQNEELITEQMAPHHKILAKAIFKLTYQNKVVKVLRPTPRGAVMDIISRKDQRGSGQVGTYGLNTFTNMEVQLIRQMEAEGVITQDDMQNPKGLKERVEKWLRECGVDRLKRMAISGDDCVVKPLDERFGTSLLFLNDMGKVRKDIPQWEPSKGWKNWQEVPFCSHHFHKIFMKDGRSLVVPCRNQDELIGRARISQGAGWSLRETACLGKAYAQMWSLMYFHRRDLRLASMAICSAVPTEWFPTSRTTWSIHAHHQWMTTEDMLKVWNRVWIEDNPNMIDKTPVHSWEDIPYLGKREDLWCGSLIGLSSRATWAKNIHTAITQVRNLIGKEEYVDYMPVMKRYSAPSESEGVL

SEQ ID NO: 5243 - protein, 3288 aa, Artificial Sequence
  derived and/or modified protein sequence (wt) from DENV-4__KJ596661__SS-prME
STITLLCLIPTVMAFHLSTRDGEPLMIVAKHERGRPLLFKTTEGINKCTLIAMDLGEMCEDTVTYKCPLLVNTEPEDIDCWCNLTSTWVMYGTCTQSGERRREKRSVALTPHSGMGLETRAETWMSSEGAWKHAQRVESWILRNPGFALLAGFMAYMIGQTGIQRTVFFVLMMLVAPSYGMRCVGVGNRDFVEGVSGGAWVDLVLEHGGCVTTMAQGKPTLDFELTKTTAKEVALLRTYCIEALISNITTATRCPTQGEPYLKEEQDQQYICRRDVVDRGWGNGCGLFGKGGVVTCAKFSCSGKITGNLVQIENLEYTVVVTVHNGDTHAVGNDTSNHGVTATITPRSPSVEVKLPDYGELTLDCEPRSGIDFNEMILMKMKKKTWLVHKQWFLDLPLPWTTGADTSEVHWNYKERMVTFKVPHAKRQDVTVLGSQEGAMHSALAGATEVDSGDGNHMFAGHLKCKVRMEKLRIKGMSYTMCSGKFSIDKEMAETQHGTTVVKVKYEGAGAPCKVPIEIRDVNKEKVVGRVISATPLAENTNSVTNIELEPPFGDSYIVIGVGNSALTLHWFRKGSSIGKMFESTYRGAKRMAILGETAWDFGSVGGLFTSLGKAVHQVFGSVYTTMFGGVSWMIRILIGFLVLWIGTNSRNTSMAMTCIAVGGITLFLGFTVQADMGCVVSWSGRELKCGSGIFVVDNVHTWTEQYKFQPESPARLASAILNAHKDGVCGIRSTTRLENVMWKQITNELNYVLWEGGHDLTVVAGDVKGVLTKGKRALTPPASDLKYSWKTWGKAKIFTPEARNSTFLIDGPDTSECPNERRAWNSFEVEDYGFGMFTTNIWMKFREGSSEVCDHRLMSAAIKDQKAVHADMGYWIESSKNQTWQIERASLIEVKTCLWPKTHTLWSNGVLESQMLIPKSYAGPFSQHNYRQGYATQTVGPWHLGKLEIDFGECPGTTVTIQENCDHRGPSLRTTTASGKLVTQWCCRSCTMPPLRFLGEDGCWYGMEIRPLSEKEENMVKSQVTAGQGTSETFSMGLLCLTLFVEECLRRRVTRKHMILAVVITLCAIILGGLTWMDLLRALIMLGDTMSGRIGGQTHLAIMAVFKMSPGYVLGVFLRKLTSRETALMVIGMAMTTTLSIPHDLMELIDGISLGLILLKIVTQFDNTQVGTLALSLTFIRSTMSLVMAWRTIMAVLFVVTLIPLCRTSCLQKQSHWVEITALILGAQALPVYLMTLMKGASRRSWPLNEGIMAVGLVSLLGSALLKNDVPLAGPMVAGGLLLAAYVMSGSSADLSLEKAANVQWDEMADITGSSPIIEVKQDEDGSFSIRDVEETNMITLLVKLALITVSGLYPLAIPITMTLWYMWQVKTQRSGALWDVPSPAATQKAALSEGVYRIMQRGLFGKTQVGVGIHIEGVFHTMWHVTRGSVICHETGRLEPSWADVRNDMISYGGGWRLGDKWDKEEDVQVLAIEPGKNPKHVQTKPGLFKTLTGEIGAVTLDFKPGTSGSPIINRKGKVIGLYGNGVVTKSGDYVSAITQAERIGEPDYEVDEDIFRKKRLTIMDLHPGAGKTKRILPSIVREALKRRLRTLILAPTRVVAAEMEEALRGLPIRYQTPAVKSEHTGREIVDLMCHATFTTRLLSSTRVPNYNLIVMDEAHFTDPSSVAARGYISTRVEMGEAAAIFMTATPPGATDPFPQSNSPIEDIEREIPERSWNTGFDWITDYQGKTVWFVPSIKAGNDIANCLRKSGKKVIQLSRKTFDTEYPKTKLTDWDFVVTTDISEMGANFRAGRVIDPRRCLKPVILTDGPERVILAGPIPVTPASAAQRRGRIGRNPAQEDDQYVFSGDPLKNDEDHAHWTEAKMLLDNIYTPEGIIPTLFGPEREKTQAIDGEFRLRGEQRKTFVELMRRGDLPVWLSYKVASAGISYKDREWCFTGERNNQILEENMEVEIWTREGEKKKLRPKWLDARVYADPMALKDFKEFASGRKSITLDILTEIASLPTYLSSRAKLALDNIVMLHTTERGGRAYQHALNELPESLETLMLVALLGAMTAGIFLFFMQGKGIGKLSMGLITIAVASGLLWVAEIQPQWIAASIILEFFLMVLLIPEPEKQRTPQDNQLIYVILTILTIIGLIAANEMGLIEKTKTDFGFYQVKTETTILDVDLRPASAWTLYAVATTILTPMLRHTIENTSANLSLAAIANQAAVLMGLGKGWPLHRMDLGVPLLAMGCYSQVNPTTLTASLVMLLVHYAIIGPGLQAKATREAQKRTAAGIMKNPTVDGITVIDLEPISYDPKFEKQLGQVMLLVLCAGQLLLMRTTWAFCEVLTLATGPTLTLWEGNPGRFWNTTIAVSTANIFRGSYLAGAGLAFSLIKNAQTPRRGTGTAGETLGEKWKRQLNSLDRKEFEEYKRSGILEVDRTEAKSALKDGSKIKHAVSRGSSKIRWIVERGMVKPKGKVVDLGCGRGGWSYYMATLKNVTEVKGYTKGGPGHEEPIPMATYGWNLVKLHSGVDVFYKPTEQVDTLLCDIGESSSNPTIEEGRTLRVLKMVEPWLSSKPEFCIKVLNPYMPTVIEELEKLQRKHGGNLVRCPLSRNSTHEMYWVSGASGNIVSSVNTTSKMLLNRFTTRHRKPTYEKDVDLGAGTRSVSTETEKPDMTIIGRRLQRLQEEHKETWHYDQENPYRTWAYHGSYEAPSTGSASSMVNGVVKLLTKPWDVIPMVTQLAMTDTTPFGQQRVFKEKVDTRTPQPKPGTRMVMTTTANWLWALLGKKKNPRLCTREEFISKVRSNAAIGAVFQEEQGWTSASEAVNDSRFWELVDKERALHQEGKCESCVYNMMGKREKKLGEFGRAKGSRAIWYMWLGARFLEFEALGFLNEDHWFGRENSWSGVEGEGLHRLGYILEEIDKKDGDLMYADDTAGWDTRITEDDLQNEELITEQMAPHHKILAKAIFKLTYQNKVVKVLRPTPRGAVMDIISRKDQRGSGQVGTYGLNTFTNMEVQLIRQMEAEGVITQDDMQNPKGLKERVEKWLRECGVDRLKRMAISGDDCVVKPLDERFGTSLLFLNDMGKARKDIPQWEPSKGWKNWQEVPFCSHHFHKIFMKDGRSLVVPCRNQDELIGRARISQGAGWSLRETACLGKAYAQMWSLMYFHRRDLRLASMAICSAVPTEWFPTSRTTWSIHAHHQWMTTEDMLKVWNRVWIEDNPNMIDKTPVHSWEDIPYLGKREDLWCGSLIGLSSRATWAKNIHTAITQVRNLIGKEEYVDYMPVMKRYSAPSESEGVL

SEQ ID NO: 5244 - protein, 3288 aa, Artificial Sequence
  derived and/or modified protein sequence (wt) from DENV-4__KJ596663__SS-prME
STITLLCLIPTVMAFHLSTRDGEPLMIVAKHERGRPLLFKTTEGINKCTLIAMDLGEMCEDTVTYKCPLLVNTEPEDIDCWCNLTSTWVMYGTCTQSGERRREKRSVALTPHSGMGLETRAETWMSSEGAWKHAQRVESWILRNPGFALLAGFMAYMIGQTGIQRTVFFVLMMLVAPSYGMRCVGVGNRDFVEGVSGGAWVDLVLEHGGCVTTMAQGKPTLDFELTKTTAKEVALLRTYCIEALISNITTATRCPTQGEPYLKEEQDQQYICRRDVVDRGWGNGCGLFGKGGVVTCAKFSCSGKITGNLVQIENLEYTVVVTVHNGDTHAVGNDTSNHGVTATITPRSPSVEVKLPDYGELTLDCEPRSGIDFNEMILMKMKKKTWLVHKQWFLDLPLPWTTGADTSEVHWNYKERMVTFKVPHAKRQDVTVLGSQEGAMHSALAGATEVDSGDGNHMFAGHLKCKVRMEKLRIKGMSYTMCSGKFSIDKEMAETQHGTTVVKVKYEGAGAPCKVPIEIRDVNKEKVVGRVISATPLAENTNSVTNIELEPPFGDSYIVIGVGNSALTLHWFRKGSSIGKMFESTYRGAKRMAILGETAWDFGSVGGLFTSLGKAVHQVFGSVYTTMFGGVSWMIRILIGFLVLWIGTNSRNTSMAMTCIAVGGITLFLGFTVQADMGCVVSWSGRELKCGSGIFVVDNVHTWTEQYKFQPESPARLASAILNAHKDGVCGIRSTTRLENVMWKQITNELNYVLWEGGHDLTVVAGDVKGVLTKGKRALTPPASDLKYSWKTWGKAKIFTPEARNSTFLIDGPDTSECPNERRAWNSFEVEDYGFGMFTTNIWMKFREGSSEVCDHRLMSAAIKDQKAVHADMGYWIESSKNQTWQIERASLIEVKTCLWPKTHTLWSNGVLESQMLIPKSYAGPFSQHNYRQGYATQTVGPWHLGKLEIDFGECPGTTVTIQENCDHRGPSLRTTTASGKLVTQWCCRSCTMPPLRFLGEDGCWYGMEIRPLSEKEENMVKSQVTAGQGTSETFSMGLLCLTLFVEECLRRRVTRKHMILAVVITLCAIILGGLTWMDLLRALIILGDTMSGRIGGQTHLAIMAVFKMSPGYVLGVFLRKLTSRETALMVIGMAMTTTLSIPHDLMELIDGISLGLILLKIVTQFDNTQVGTLALSLTFIRSTMSLVMAWRTIMAVLFVVTLIPLCRTSCLQKQSHWVEITALILGAQALPVYLMTLMKGASRRSWPLNEGIMAVGLVSLLGSALLKNDVPLAGPMVAGGLLLAAYVMSGSSADLSLEKAANVQWDEMADITGSSPIIEVKQDEDGSFSIRDVEETNMITLLVKLALITVSGLYPLAIPITMTLWYMWQVKTQRSGALWDVPSPAATQKAALSEGVYRIMQRGLFGKTQVGVGIHMEGVFHTMWHVTRGSVICHETGRLEPSWADVRNDMISYGGGWRLGDKWDKEEDVQVLAIEPGKNPKHVQTKPGLFKTLTGEIGAVTLDFKPGTSGSPIINRKGKVIGLYGNGVVTKSGDYVSAITQAERIGEPDYEVDEDIFRKKRLTIMDLHPGAGKTKRILPSIVREALKRRLRTLILAPTRVVAAEMEEALRGLPIRYQTPAVKSEHTGREIVDLMCHATFTTRLLSSTRVPNYNLIVMDEAHFTDPSSVAARGYISTRVEMGEAAAIFMTATPPGATDPFPQSNSPIEDIEREIPERSWNTGFDWITDYQGKTVWFVPSIKAGNDIANCLRKSGKKVIQLSRKTFDTEYPKTKLTDWDFVVTTDISEMGANFRAGRVIDPRRCLKPVILTDGPERVILAGPIPVTPASAAQRRGRIGRNPAQEDDQYVFSGDPLKNDEDHAHWTEAKMLLDNIYTPEGIIPTLFGPEREKTQAIDGEFRLRGEQRKTFVELMRRGDLPVWLSYKVASAGISYKDREWCFTGERNNQILEENMEVEIWTREGEKKKLRPKWLDARVYADPMALKDFKEFASGRKSITLDILTEIASLPTYLSSRAKLALDNIVMLHTTERGGRAYQHALNELPESLETLMLVALLGAMTAGIFLFFMQGKGIGKLSMGLITIAVASGLLWVAEIQPQWIAASIILEFFLMVLLIPEPEKQRTPQDNQLIYVILTILTIIGLIAANEMGLIEKTKTDFGFYQVKTETTILDVDLRPASAWTLYAVATTILTPMLRHTIENTSANLSLAAIANQAAVLMGLGKGWPLHRMDLGVPLLAMGCYSQVNPTTLTASLVMLLVHYAIIGPGLQAKATREAQKRTAAGIMKNPTVDGITVIDLEPISYDPKFEKQLGQVMLLVLCAGQLLLMRTTWAFCEVLTLATGPILTLWEGNPGRFWNTTIAVSTANIFRGSYLAGAGLAFSLIKNAQTPRRGTGTAGETLGEKWKRQLNSLDRKEFEEYKRSGILEVDRTEAKSALKDGSKIKHAVSRGSSKIRWIVERGMVKPKGKVVDLGCGRGGWSYYMATLKNVTEVKGYTKGGPGHEEPIPMATYGWNLVKLHSGVDVFYKPTEQVDTLLCDIGESSSNPTIEEGRTLRVLKMVEPWLSSKPEFCIKVLNPYMPTVIEELEKLQRKHGGNLVRCPLSRNSTHEMYWVSGASGNIVSSVNTTSKMLLNRFTTRHRKPTYEKDVDLGAGTRSVSTETEKPDMTIIGRRLQRLQEEHKETWHYDQENPYRTWAYHGSYEAPSTGSASSMVNGVVKLLTKPWDVIPMVTQLAMTDTTPFGQQRVFKEKVDTRTPQPKPGTRMVMTTTANWLWALLGKKKNPRLCTREEFISKVRSNAAIGAVFQEEQGWTSASEAVNDSRFWELVDKERALHQEGKCESCVYNMMGKREKKLGEFGRAKGSRAIWYMWLGARFLEFEALGFLNEDHWFGRENSWSGVEGEGLHRLGYILEEIDKKDGDLMYADDTAGWDTRITEDDLQNEELITEQMAPHHKTLAKAIFKLTYQNKVVKVLRPTPRGAVMDIISRKDQRGSGQVGTYGLNTFTNMEVQLIRQMEAEGVITQDDMQNPKGLKERVEKWLRECGVDRLKRMAISGDDCVVKPLDERFGTSLLFLNDMGKVRKDIPQWEPSKGWKNWQEVPFCSHHFHKIFMKDGRSLVVPCRNQDELIGRARISQGAGWSLRETACLGKAYAQMWSLMYFHRRDLRLASMAICSAVPTEWFPTSRTTWSIHAHHQWMTTEDMLKVWNRVWIEDNPNMIDKTPVHSWEDIPYLGKREDLWCGSLIGLSSRATWAKNIHTAITQVRNLIGKEEYVDYMPVMKRYSAPSESEGVL

SEQ ID NO: 5245 - protein, 3288 aa, Artificial Sequence
  derived and/or modified protein sequence (wt) from DENV-4__KJ596664__SS-prME
STITLLCLIPTVMAFHLSTRDGEPLMIVAKHERGRPLLFKTTEGINKCTLIAMDLGEMCEDTVTYKCPLLVNTEPEDIDCWCNLTSTWVMYGTCTQSGERRREKRSVALTPHSGMGLETRAETWMSSEGAWKHAQRVESWILRNPGFALLAGFMAYMIGQTGIQRTVFFVLMMLVAPSYGMRCVGVGNRDFVEGVSGGAWVDLVLEHGGCVTTMAQGKPTLDFELTKTTAKEVALLRTYCIEALISNITTATRCPTQGEPYLKEEQDQQYICRRDVVDRGWGNGCGLFGKGGVVTCAKFSCSGKITGNLVQIENLEYTVVVTVHNGDTHAVGNDTSNHGVTATITPRSPSVEVKLPDYGELTLDCEPRSGIDFNEMILMKMKKKTWLVHKQWFLDLPLPWTTGADTSEVHWNYKERMVTFKVPHAKRQDVTVLGSQEGAMHSALAGATEVDSGDGNHMFAGHLKCKVRMEKLRIKGMSYTMCSGKFSIDKEMAETQHGTTVVKVKYEGAGAPCKVPIEIRDVNKEKVVGRVISATPLAENTNSVTNIELEPPFGDSYIVIGVGNSALTLHWFRKGSSIGKMFESTYRGAKRMAILGETAWDFGSVGGLFTSLGKAVHQVFGSVYTTMFGGVSWMIRILIGFLVLWIGTNSRNTSMAMTCIAVGGITLFLGFTVQADMGCVVSWSGRELKCGSGIFVVDNVHTWTEQYKFQPESPARLASAILNAHKDGVCGIRSTTRLENVMWKQITNELNYVLWEGGHDLTVVAGDVKGVLTKGKRALTPPASDLKYSWKTWGKAKIFTPEARNSTFLIDGPDTSECPNERRAWNSFEVEDYGFGMFTTNIWMKFREGSSEVCDHRLMSAAIKDQKAVHADMGYWIESSKNQTWQIERASLIEVKTCLWPKTHTLWSNGVLESQMLIPKSYAGPFSQHNYRQGYATQTVGPWHLGKLEIDFGECPGTTVTIQENCDHRGPSLRTTTASGKLVTQWCCRSCTMPPLRFLGEDGCWYGMEIRPLSEKEENMVKSQVTAGQGTSETFSMGLLCLTLFVEECLRRRVTRKHMILAVVITLCAIILGGLTWMDLLRALIMLGDTMSGRIGGQTHLAIIAVFKMSPGYVLGVFLRKLTSRETALMVIGMAMTTTLSIPHDLMELIDGISLGLILLKIVTQFDNTQVGTLALSLTFIRSTMSLVMAWRTIMAVLFVVTLIPLCRTSCLQKQSHWVEITALILGAQALPVYLMTLMKGASRRSWPLNEGIMAVGLVSLLGSALLKNDVPLAGPMVAGGLLLAAYVMSGSSADLSLEKAANVQWDEMADITGSSPIIEVKQDEDGSFSIRDVEETNMITLLVKLALITVSGLYPLAIPITMTLWYMWQVKTQRSGALWDVPSPAATQKAALSEGVYRIMQRGLFGKTQVGVGIHMEGVFHTMWHVTRGSVICHETGRLEPSWADVRNDMISYGGGWRLGDKWDKEEDVQVLAIEPGKNPKHVQTKPGLFKTLTGEIGAVTLDFKPGTSGSPIINRKGKVIGLYGNGVVTKSGDYVSAITQAERIGEPDYEVDEDIFRKKRLTIMDLHPGAGKTKRILPSIVREALKRRLRTLILAPTRVVAAEMEEALRGLPIRYQTPAVKSEHTGREIVDLMCHATFTTRLLSSTRVPNYNLIVMDEAHFTDPSSVAARGYISTRVEMGEAAAIFMTATPPGATDPFPQSNSPIEDIEREIPERSWNTGFDWITDYQGKTVWFVPSIKAGNDIANCLRKSGKKVIQLSRKTFDTEYPKTKLTDWDFVVTTDISEMGANFRAGRVIDPRRCLKPVILTDGPERVILAGPIPVTPASAAQRRGRIGRNPAQEDDQYVFSGDPLKNDEDHAHWTEAKMLLDNIYTPEGIIPTLFGPEREKTQAIDGEFRLRGEQRKTFVELMRRGDLPVWLSYKVASAGISYKDREWCFTGERNNQILEENMEVEIWTREGEKKKLRPKWLDARVYADPMALKDFKEFASGRKSITLDILTEIASLPTYLSSRAKLALDNIVMLHTTERGGRAYQHALNELPESLETLMLVALLGAMTAGIFLFFMQGKGIGKLSMGLITIAVASGLLWVAEIQPQWIAASIILEFFLMVLLIPEPEKQRTPQDNQLIYVILTILTIIGLIAANEMGLIEKTKTDFGFYQVKTETTILDVDLRPASAWTLYAVATTILTPMLRHTIENTSANLSLAAIANQAAVLMGLGKGWPLHRMDLGVPLLAMGCYSQVNPTTLTASLVMLLVHYAIIGPGLQAKATREAQKRTAAGIMKNPTVDGITVIDLEPISYDPKFEKQLGQVMLLVLCAGQLLLMRTTWAFCEVLTLATGPILTLWEGNPGRFWNTTIAVSTANIFRGSYLAGAGLAFSLIKNAQTPRRGTGTAGETLGEKWKRQLNSLDRKEFEEYKRSGILEVDRTEAKSALKDGSKIKHAVSRGSSKIRWIVERGMVKPKGKVVDLGCGRGGWSYYMATLKNVTEVKGYTKGGPGHEEPIPMATYGWNLVKLHSGVDVFYKPTEQVDTLLCDIGESSSNPTIEEGRTLRVLKMVEPWLSSKPEFCIKVLNPYMPTVIEELEKLQRKHGGNLVRCPLSRNSTHEMYWVSGASGNIVSSVNTTSKMLLNRFTTRHRKPTYEKDVDLGAGTRSVSTEIEKPDMTIIGRRLQRLQEEHKETWHYDQENPYRTWAYHGSYEAPSTGSASSMVNGVVKLLTKPWDVIPMVTQLAMTDTTPFGQQRVFKEKVDTRTPQPKPGTRMVMTTTANWLWALLGKKKNPRLCTREEFISKVRSNAAIGAVFQEEQGWTSASEAVNDSRFWELVDKERALHQEGKCESCVYNMMGKREKKLGEFGRAKGSRAIWYMWLGARFLEFEALGFLNEDHWFGRENSWSGVEGEGLHRLGYILEEIDKKDGDLMYADDTAGWDTRITEDDLQNEELITEQMAPHHKILAKAIFKLTYQNKVVKVLRPTPRGAVMDIISRKDQRGSGQVGTYGLNTFTNMEVQLIRQMEAEGVITQDDMQNPKGLKERVEKWLRECGVDRLKRMAISGDDCVVKPLDERFGTSLLFLNDMGKVRKDIPQWEPSKGWKNWQEVPFCSHHFHKIFMKDGRSLVVPCRNQDELIGRARISQGAGWNLRETACLGKAYAQMWSLMYFHRRDLRLASMAICSAVPTEWFPTSRTTWSIHAHHQWMTTEDMLKVWNRVWIEDNPNMIDKTPVHSWEDIPYLGKREDLWCGSLIGLSSRATWAKNIHTAITQVRNLIGKEEYVDYMSVMKRYSAPSESEGVL

SEQ ID NO: 5246 - protein, 3288 aa, Artificial Sequence
  derived and/or modified protein sequence (wt) from DENV-4__KJ596665__SS-prME
STITLLCLIPTVMAFHLSTRDGEPLMIVAKHERGRPLLFKTTEGINKCTLIAMDLGEMCEDTVTYKCPLLVNTEPEDIDCWCNLTSTWVMYGTCTQSGERRREKRSVALTPHSGMGLETRAETWMSSEGAWKHAQRVESWILRNPGFALLAGFMAYMIGQTGIQRTVFFVLMMLVAPSYGMRCVGVGNRDFVEGVSGGAWVDLVLEHGGCVTTMAQGKPTLDFELTKTTAKEVALLRTYCIEALISNITTATRCPTQGEPYLKEEQDQQYICRRDVVDRGWGNGCGLFGKGGVVTCAKFSCSGKITGNLVQIENLEYTVVVTVHNGDTHAVGNDTSNHGVTATITPRSPSVEVKLPDYGELTLDCEPRSGIDFNEMILMKMKKKTWLVHKQWFLDLPLPWTTGADTSEVHWNYKERMVTFKVPHAKRQDVTVLGSQEGAMHSALAGATEVDSGDGNHMFAGHLKCKVRMEKLRIKGMSYTMCSGKFSIDKEMAETQHGTTVVKVKYEGAGAPCKVPIEIRDVNKEKVVGRVISATPLAENTNSVTNIELEPPFGDSYIVIGVGNSALTLHWFRKGSSIGKMFESTYRGAKRMAILGETAWDFGSVGGLFTSLGKAVHQVFGSVYTTMFGGVSWMIRILIGFLVLWIGTNSRNTSMAMTCIAVGGITLFLGFTVQADMGCVVSWSGRELKCGSGIFVVDNVHTWTEQYKFQPESPARLASAILNAHKDGVCGIRSTTRLENVMWKQITNELNYVLWEGGHDLTVVAGDVKGVLTKGKRALTPPASGLKYSWKTWGKAKIFTPEARNSTFLIDGPDTSECPNERRAWNSFEVEDYGFGMFTTNIWMKFREGSSEVCDHRLMSAAIKDQKAVHADMGYWIESSKNQTWQIERASLIEVKTCLWPKTHTLWSNGVLESQMLIPKSYAGPFSQHNYRQGYATQTVGPWHLGKLEIDFGECPGTTVTIQENCDHRGPSLRTTTASGKLVTQWCCRSCTMPPLRFLGEDGCWYGMEIRPLSEKEENMVKSQVTAGQGTSETFSMGLLCLTLFVEECLRRRVTRKHMILAVVITLCAIILGGLTWMDLLRALIILGDTMSGRIGGQTHLAIMAVFKMSPGYVLGVFLRKLTSRETALMVIGMAMTTTLSIPHDLMELIDGISLGLILLKIVTQFDNTQVGTLALSLTFIRSTMSLVMAWRTIMAVLFVVTLIPLCRTSCLQKQSHWVEITALILGAQALPVYLMTLMKGASRRSWPLNEGIMAVGLVSLLGSALLKNDVPLAGPMVAGGLLLAAYVMSGSSADLSLEKAANVQWDEMADITGSSPIIEVKQDEDGSFSIRDVEETNMITLLVKLALITVSGLYPLAIPITMTLWYMWQVKTQRSGALWDVPSPAATQKAALSEGVYRIMQRGLFGKTQVGVGIHMEGVFHTMWHVTRGSVICHETGRLEPSWADVRNDMISYGGGWRLGDKWDKEEDVQVLAIEPGKNPKHVQTKPGLFKTLTGEIGAVTLDFKPGTSGSPIINRKGKVIGLYGNGVVTKSGDYVSAITQAERIGEPDYEVDEDIFRKKRLTIMDLHPGAGKTKRILPSIVREALKRRLRTLILAPTRVVAAEMEEALRGLPIRYQTPAVKSEHTGREIVDLMCHATFTTRLLSSTRVPNYNLIVMDEAHFTDPSSVAARGYISTRVEMGEAAAIFMTATPPGATDPFPQSNSPIEDIEREIPERSWNTGFDWITDYQGKTVWFVPSIKAGNDIANCLRKSGKKVIQLSRKTFDTEYPKTKLTDWDFVVTTDISEMGANFRAGRVIDPRRCLKPVILTDGPERVILAGPIPVTPASAAQRRGRIGRNPAQEDDQYVFSGDPLKNDEDHAHWTEAKMLLDNIYTPEGIIPTLFGPEREKTQAIDGEFRLRGEQRKTFVELMRRGDLPVWLSYKVASAGISYKDREWCFTGERNNQILEENMEVEIWTREGEKKKLRPKWLDARVYADPMALKDFKEFASGRKSITLDILTEIASLPTYLSSRAKLALDNIVMLHTTERGGRAYQHALNELPESLETLMLVALLGAMTAGIFLFFMQGKGIGKLSMGLITIAVASGLLWVAEIQPQWIAASIILEFFLMVLLIPEPEKQRTPQDNQLIYVILTILTIIGLIAANEMGLIEKTKTDFGFYQVKTETTILDVDLRPASAWTLYAVATTILTPMLRHTIENTSANLSLAAIANQAAVLMGLGKGWPLHRMDLGVPLLAMGCYSQVNPTTLTASLVMLLVHYAIIGPGLQAKATREAQKRTAAGIMKNPTVDGITVIDLEPISYDPKFEKQLGQVMLLVLCAGQLLLMRTTWAFCEVLTLATGPILTLWEGNPGRFWNTTIAVSTANIFRGSYLAGAGLAFSLIKNAQTPRRGTGTAGETLGEKWKRQLNSLDRKEFEEYKRSGILEVDRTEAKSALKDGSKIKHAVSRGSSKIRWIVERGMVKPKGKVVDLGCGRGGWSYYMATLKNVTEVKGYTKGGPGHEEPIPMATYGWNLVKLHSGVDVFYKPTEQVDTLLCDIGESSSNPTIEEGRTLRVLKMVEPWLSSKPEFCIKVLNPYMPTVIEELEKLQRKHGGNLVRCPLSRNSTHEMYWVSGASGNIVSSVNTTSKMLLNRFTTRHRKPTYEKDVDLGAGTRSVSTETEKPDMTIIGRRLQRLQEEHKETWHYDQENPYRTWAYHGSYEAPSTGSASSMVNGVVKLLTKPWDVIPMVTQLAMTDTTPFGQQRVFKEKVDTRTPQPKPGTRMVMTTTANWLWALLGKKKNPRLCTREEFISKVRSNAAIGAVFQEEQGWTSASEAVNDSRFWELVDKERALHQEGKCESCVYNMMGKREKKLGEFGRAKGSRAIWYMWLGARFLEFEALGFLNEDHWFGRENSWSGVEGEGLHRLGYILEEIDKKDGDLMYADDTAGWDTRITEDDLQNEELITEQMAPHHKILAKAIFKLTYQNKVVKVLRPTPRGAVMDIISRKDQRGSGQVGTYGLNTFTNMEVQLIRQMEAEGVITQDDMQNPKGLKERVEKWLRECGVDRLKRMAISGDDCVVKPLDERFGTSLLFLNDMGKVRKDIPQWEPSKGWKNWQEVPFCSHHFHKIFMKDGRSLVVPCRNQDELIGRARISQGAGWSLRETACLGKAYAQMWSLMYFHRRDLRLASMAICSAVPTEWFPTSRTTWSIHAHHQWMTTENMLKVWNRVWIEDNPNMIDKTPVHSWEDIPYLGKREDLWCGSLIGLSSRATWAKNIHTAITQVRNLIGKEEYVDYMPVMKRYSAPSESEGVL

SEQ ID NO: 5247 - protein, 3288 aa, Artificial Sequence
  derived and/or modified protein sequence (wt) from DENV-4__KJ596668__SS-prME
STITLLCLIPTVMAFHLSTRDGEPLMIVAKHERGRPLLFKTTEGINKCTLIAMDLGEMCEDTVTYKCPLLVNTEPEDIDCWCNLTSTWVMYGTCTQSGERRREKRSVALTPHSGMGLETRAETWMSSEGAWKHAQRVESWILRNPGFALLAGFMAYMIGQTGIQRTVFFVLMMLVAPSYGMRCVGVGNRDFVEGVSGGAWVDLVLEHGGCVTTMAQGKPTLDFELTKTTAKEVALLRTYCIEALISNITTATRCPTQGEPYLKEEQDQQYICRRDVVDRGWGNGCGLFGKGGVVTCAKFSCSGKITGNLVQIENLEYTVVVTVHNGDTHAVGNDTSNHGVTATITPRSPSVEVKLPDYGELTLDCEPRSGIDFNEMILMKMKKKTWLVHKQWFLDLPLPWTTGADTSEVHWNYKERMVTFKVPHAKRQDVTVLGSQEGAMHSALAGATEVDSGDGNHMFAGHLKCKVRMEKLRIKGMSYTMCSGKFSIDKEMAETQHGTTVVKVKYEGAGAPCKVPIEIRDVNKEKVVGRVISATPLAENTNSVTNIELEPPFGDSYIVIGVGNSALTLHWFRKGSSIGKMFESTYRGAKRMAILGETAWDFGSVGGLFTSLGKAVHQVFGSVYTTMFGGVSWMIRILIGFLVLWIGTNSRNTSMAMTCIAVGGITLFLGFTVQADMGCVVSWSGRELKCGSGIFVVDNVHTWTEQYKFQPESPARLASAILNAHKDGVCGIRSTTRLENVMWKQITNELNYVLWEGGHDLTVVAGDVKGVLTKGKRALTPPASDLKYSWKTWGKAKIFTPEARNSTFLIDGPDTSECPNERRAWNSFEVEDYGFGMFTTNIWMKFREGSSEVCDHRLMSAAIKDQKAVHADMGYWIESSKNQTWQIERASLIEVKTCLWPKTHTLWSNGVLESQMLIPKSYAGPFSQHNYRQGYATQTVGPWHLGKLEIDFGECPGTTVTIQENCDHRGPSLRTTTASGKLVTQWCCRSCTMPPLRFLGEDGCWYGMEIRPLSEKEENMVKSQVTAGQGTSETFSMGLLCLTLFVEECLRRRVTRKHMILAVVITLCAIILGGLTWMDLLRALIILGDTMSGRIGGQTHLAIMAVFKMSPGYVLGVFLRKLTSRETALMVIGMAMTTTLSIPHDLMELIDGISLGLILLKIVTQFDNTQVGTLALSLTFIRSTMSLVMAWRTIMAVLFVVTLIPLCRTSCLQKQSHWVEITALILGAQALPVYLMTLMKGASRRSWPLNEGIMAVGLVSLLGSALLKNDVPLAGPMVAGGLLLAAYVMSGSSADLSLEKAANVQWDEMADITGSSPIIEVKQDEDGSFSIRDVEETNMITLLVKLALITVSGLYPLAIPVTMTLWYMWQVKTQRSGALWDVPSPAATQKAALSEGVYRIMQRGLFGKTQVGVGIHMEGVFHTMWHVTRGSVICHETGRLEPSWADVRNDMISYGGGWRLGDKWDKEEDVQVLAIEPGKNPKHVQTKPGLFKTLTGEIGAVTLDFKPGTSGSPIINRKGKVIGLYGNGVVTKSGDYVSAITQAERIGEPDYEVDEDIFRKKRLTIMDLHPGAGKTKRILPSIVREALKRRLRTLILAPTRVVAAEMEEALRGLPIRYQTPAVKSEHTGREIVDLMCHATFTTRLLSSTRVPNYNLIVMDEAHFTDPSSVAARGYISTRVEMGEAAAIFMTATPPGATDPFPQSNSPIEDIEREIPERSWNTGFDWITDYQGKTVWFVPSIKAGNDIANCLRKSGKKVIQLSRKTFDTEYPKTKLTDWDFVVTTDISEMGANFRAGRVIDPRRCLKPVILTDGPERVILAGPIPVTPASAAQRRGRIGRNPAQEDDQYVFSGDPLKNDEDHAHWTEAKMLLDNIYTPEGIIPTLFGPEREKTQAIDGEFRLRGEQRKTFVELMRRGDLPVWLSYKVASAGISYKDREWCFTGERNNQILEENMEVEIWTREGEKKKLRPKWLDARVYADPMALKDFKEFASGRKSITLDILTEIASLPTYLSSRAKLALDNIVMLHTTERGGRAYQHALNELPESLETLMLVALLGAMTAGIFLFFMQGKGIGKLSMGLITIAVASGLLWVAEIQPQWIAASIILEFFLMVLLIPEPEKQRTPQDNQLIYVILTILTIIGLIAANEMGLIEKTKTDFGFYQVKTETTILDVDLRPASAWTLYAVATTILTPMLRHTIENTSANLSLAAIANQAAVLMGLGKGWPLHRMDLGVPLLAMGCYSQVNPTTLTASLVMLLVHYAIIGPGLQAKATREAQKRTAAGIMKNPTVDGITVIDLEPISYDPKFEKQLGQVMLLVLCAGQLLLMRTTWAFCEVLTLATGPILTLWEGNPGRFWNTTIAVSTANIFRGSYLAGAGLAFSLIKNAQTPRRGTGTAGETLGEKWKRQLNSLDRKEFEEYKRSGILEVDRTEAKSALKDGSKIKHAVSRGSSKIRWIVERGMVKPKGKVVDLGCGRGGWSYYMATLKNVTEVKGYTKGGPGHEEPIPMATYGWNLVKLHSGVDVFYKPTEQVDTLLCDIGESSSNPTIEEGRTLRVLKMVEPWLSSKPEFCIKVLNPYMPTVIEELEKLQRKHGGNLVRCPLSRNSTHEMYWVSGASGNIVSSVNTTSKMLLNRFTTRHRKPTYEKDVDLGAGTRSVSTETEKPDMTIIGRRLQRLQEEHKETWHYDQENPYRTWAYHGSYEAPSTGSASSMVNGVVKLLTKPWDVIPMVTQLAMTDTTPFGQQRVFKEKVDTRTPQPKPGTRMVMTTTANWLWALLGKKKNPRLCTREEFISKVRSNAAIGAVFQEEQGWTSASEAVNDSRFWELVDKERALHQEGKCESCVYNMMGKREKKLGEFGRAKGSRAIWYMWLGARFLEFEALGFLNEDHWFGRENSWSGVEGEGLHRLGYILEEIDKKDGDLMYADDTAGWDTRITEDDLQNEELITEQMAPHHKILAKAIFKLTYQNKVVKVLRPTPRGAVMDIISRKDQRGSGQVGTYGLNTFTNMEVQLIRQMEAEGVITQDDMQNPKGLKERVEKWLREYGVDRLKRMAISGDDCVVKPLDERFGTSLLFLNDMGKVRKDIPQWEPSKGWKNWQEVPFCSHHFHKIFMKDGRSLVVPCRNQDELIGRARISQGAGWSLRETACLGKAYAQMWSLMYFHRRDLRLASMAICSAVPTEWFPTSRTTWSIHAHHQWMTTEDMLKVWNRVWIEDNPNMIDKTPVHSWEDIPYLGKREDLWCGSLIGLSSRATWAKNIHTAITQVRNLIGKEEYVDYMPVMKRYSAPSESEGVL

SEQ ID NO: 5248 - protein, 3288 aa, Artificial Sequence
  derived and/or modified protein sequence (wt) from DENV-4__KJ596670__SS-prME
STITLLCLIPTVMAFHLSTRDGEPLMIVAKHERGRPLLFKTTEGINKCTLIAMDLGEMCEDTVTYKCPLLVNTEPEDIDCWCNLTSTWVMYGTCTQSGERRREKRSVALTPHSGMGLETRAETWMSSEGAWKHAQRVESWILRNPGFALLAGFMAYMIGQTGIQRTVFFVLMMLVAPSYGMRCVGVGNRDFVEGVSGGAWVDLVLEHGGCVTTMAQGKPTLDFELTKTTAKEVALLRTYCIEALISNITTATRCPTQGEPYLKEEQDQQYICRRDVVDRGWGNGCGLFGKGGVVTCAKFSCSGKITGNLVQIENLEYTVVVTVHNGDTHAVGNDTSNHGVTATITPRSPSVEVKLPDYGELTLDCEPRSGIDFNEMILMKMKKKTWLVHKQWFLDLPLPWTTGADTSEVHWNYKERMVTFKVPHAKRQDVTVLGSQEGAMHSALAGATEVDSGDGNHMFAGHLKCKVRMEKLRIKGMSYTMCSGKFSIDKEMAETQHGTTVVKVKYEGAGAPCKVPIEIRDVNKEKVVGRVISATPLAENTNSVTNIELEPPFGDSYIVIGVGNSALTLHWFRKGSSIGKMFESTYRGAKRMAILGETAWDFGSVGGLFTSLGKAVHQVFGSVYTTMFGGVSWMIRILIGFLVLWIGTNSRNTSMAMTCIAVGGITLFLGFTVQADMGCVVSWSGRELKCGSGIFVVDNVHTWTEQYKFQPESPARLASAILNAHKDGVCGIRSTTRLENVMWKQITNELNYVLWEGGHDLTVVAGDVKGVLTKGKRALTPPASDLKYSWKTWGKAKIFTPEARNSTFLIDGPDTSECPNERRAWNSFEVEDYGFGMFTTNIWMKFREGSSEVCDHRLMSAAIKDQKAVHADMGYWIESSKNQTWQIERASLIEVKTCLWPKTHTLWSNGVLESQMLIPKSYAGPFSQHNYRQGYATQTVGPWHLGKLEIDFGECPGTTVTIQENCDHRGPSLRTTTASGKLVTQWCCRSCTMPPLRFLGEDGCWYGMEIRPLSEKEENMVKSQVTAGQGTSETFSMGLLCLTLFVEECLRRRVTRKHMILAVVITLCAIVLGGLTWMDLLRALIMLGDTMSGRIGGQTHLAIIAVFKMSPGYVLGVFLRKLTSRETALMVIGMAMTTTLSIPHDLMELIDGISLGLILLKIVTQFDNTQVGTLALSLTFIRSTMSLVMAWRTIMAVLFVVTLIPLCRTSCLQKQSHWVEITALILGAQALPVYLMTLMKGASRRSWPLNEGIMAVGLVSLLGSALLKNDVPLAGPMVAGGLLLAAYVMSGSSADLSLEKAANVQWDEMADITGSSPIIEVKQDEDGSFSIRDVEETNMITLLVKLALITVSGLYPLAIPITMTLWYMWQVKTQRSGALWDVPSPAATQKAALSEGVYRIMQRGLFGKTQIGVGIHMEGVFHTMWHVTRGSVICHETGRLEPSWADVRNDMISYGGGWRLGDKWDKEEDVQVLAIEPGKNPKHVQTKPGLFKTLTGEIGAVTLDFKPGTSGSPIINRKGKVIGLYGNGVVTKSGDYVSAITQAERIGEPDYEVDEDIFRKKRLTIMDLHPGAGKTKRILPSIVREALKRRLRTLILAPTRVVAAEMEEALRGLPIRYQTPAVKSEHTGREIVDLMCHATFTTRLLSSTRVPNYNLIVMDEAHFTDPSSVAARGYISTRVEMGEAAAIFMTATPPGATDPFPQSNSPIEDIEREIPERSWNTGFDWITDYQGKTVWFVPSIKAGNDIANCLRKSGKKVIQLSRKTFDTEYPKTKLTDWDFVVTTDISEMGANFRAGRVIDPRRCLKPVILTDGPERVILAGPIPVTPASAAQRRGRIGRNPAQEDDQYVFSGDPLKNDEDHAHWTEAKMLLDNIYTPEGIIPTLFGPEREKTQAIDGEFRLRGEQRKTFVELMRRGDLPVWLSYKVASAGISYKDREWCFTGERNNQILEENMEVEIWTREGEKKKLRPKWLDARVYADPMALKDFKEFASGRKSITLDILTEIASLPTYLSSRAKLALDNIVMLHTTERGGRAYQHALNELPESLETLMLVALLGAMTAGIFLFFMQGKGIGKLSMGLITIAVASGLLWVAEIQPQWIAASIILEFFLMVLLIPEPEKQRTPQDNQLIYVILTILTIIGLIAANEMGLIEKTKTDFGFYQVKTETTILDVDLRPASAWTLYAVATTILTPMLRHTIENTSANLSLAAIANQAAVLMGLGKGWPLHRMDLGVPLLAMGCYSQVNPTTLTASLVMLLVHYAIIGPGLQAKATREAQKRTAAGIMKNPTVDGITVIDLEPISYDPKFEKQLGQVMLLVLCAGQLLLMRTTWAFCEVLTLATGPILTLWEGNPGRFWNTTIAVSTANIFRGSYLAGAGLAFSLIKNAQTPRRGTGTAGETLGEKWKRQLNSLDRKEFEEYKRSGILEVDRTEAKSALKDGSKIKHAVSRGSSKIRWIVERGMVKPKGKVVDLGCGRGGWSYYMATLKNVTEVKGYTKGGPGHEEPIPMATYGWNLVKLHSGVDVFYKPTEQVDTLLCDIGESSSNPTIEEGRTLRVLKMVEPWLSSKPEFCIKVLNPYMPTVIEELEKLQRKHGGNLVRCPLSRNSTHEMYWVSGASGNIVSSVNTTSKMLLNRFTTRHRKPTYEKDVDLGAGTRSVSTEIEKPDMTIIGRRLQRLQEEHKETWHYDQENPYRTWAYHGSYEAPSTGSASSMVNGVVKLLTKPWDVIPMVTQLAMTDTTPFGQQRVFKEKVDTRTPQPKPGTRMVMTTTANWLWALLGKKKNPRLCTREEFISKVRSNAAIGAVFQEEQGWTSASEAVNDSRFWELVDKERALHQEGKCESCVYNMMGKREKKLGEFGRAKGSRAIWYMWLGARFLEFEALGFLNEDHWFGRENSWSGVEGEGLHRLGYILEEIDKKDGDLMYADDTAGWDTRITEDDLQNEELITEQMAPHHKILAKAIFKLTYQNKVVKVLRPTPRGAVMDIISRKDQRGSGQVGTYGLNTFTNMEVQLIRQMEAEGVITQDDMQNPKGLKERVEKWLRECGVDRLKRMAISGDDCVVKPLDERFGTSLLFLNDMGKVRKDIPQWEPSKGWKNWQEVPFCSHHFHKIFMKDGRSLVVPCRNQDELIGRARISQGAGWSLRETACLGKAYAQMWSLMYFHRRDLRLASMAICSAVPTEWFPTSRTTWSIHAHHQWMTTEDMLKVWNRVWIEDNPNMIDKTPVHSWEDIPYLGKREDLWCGSLIGLSSRATWAKNIHTAITQVRNLIGKEEYVDYMSVMKRYSAPSESEGVL

SEQ ID NO: 5249 - protein, 3288 aa, Artificial Sequence
  derived and/or modified protein sequence (wt) from DENV-4__KJ596671__SS-prME
STITLLCLIPTVMAFHLSTRDGEPLMIVAKHERGRPLLFKTTEGINKCTLIAMDLGEMCEDTVTYKCPLLVNTEPEDIDCWCNLTSTWVMYGTCTQSGERRREKRSVALTPHSGMGLETRAETWMSSEGAWKHAQRVESWILRNPGFALLAGFMAYMIGQTGIQRTVFFVLMMLVAPSYGMRCVGVGNRDFVEGVSGGAWVDLVLEHGGCVTTMAQGKPTLDFELTKTTAKEVALLRTYCIEALISNITTATRCPTQGEPYLKEEQDQQYICRRDVVDRGWGNGCGLFGKGGVVTCAKFSCSGKITGNLVQIENLEYTVVVTVHNGDTHAVGNDTSNHGVTATITPRSPSVEVKLPDYGELTLDCEPRSGIDFNEMILMKMKKKTWLVHKQWFLDLPLPWTTGADTSEVHWNYKERMVTFKVPHAKRQDVTVLGSQEGAMHSALAGATEVDSGDGNHMFAGHLKCKVRMEKLRIKGMSYTMCSGKFSIDKEMAETQHGTTVVKVKYEGAGAPCKVPIEIRDVNKEKVVGRVISATPLAENTNSVTNIELEPPFGDSYIVIGVGNSALTLHWFRKGSSIGKMFESTYRGAKRMAILGETAWDFGSVGGLFTSLGKAVHQVFGSVYTTMFGGVSWMIRILIGFLVLWIGTNSRNTSMAMTCIAVGGITLFLGFTVQADMGCVVSWSGRELKCGSGIFVVDNVHTWTEQYKFQPESPARLASAILNAHKDGVCGIRSTTRLENVMWKQITNELNYVLWEGGHDLTVVAGDVKGVLTKGKRALTPPASDLKYSWKTWGKAKIFTPEARNSTFLIDGPDTSECPNERRAWNSFEVEDYGFGMFTTNIWMKFREGSSEVCDHRLMSAAIKDQKAVHADMGYWIESSKNQTWQIERASLIEVKTCLWPKTHTLWSNGVLESQMLIPKSYAGPFSQHNYRQGYATQTVGPWHLGKLEIDFGECPGTTVTIQENCDHRGPSLRTTTASGKLVTQWCCRSCTMPPLRFLGEDGCWYGMEIRPLSEKEENMVKSQVTAGQGTSETFSMGLLCLTLFVEECLRRRVTRKHMILAVVITLCAIILGGLTWMDLLRALIMLGDTMSGRIGGQTHLAIIAVFKMSPGYVLGVFLRKLTSRETALMVIGMAMTTTLSIPHDLMELIDGISLGLILLKIVTQFDNTQVGTLALSLTFIRSTMSLVMAWRTIMAVLFVVTLIPLCRTSCLQKQSHWVEITALILGAQALPVYLMTLMKGASRRSWPLNEGIMAVGLVSLLGSALLKNDVPLAGPMVAGGLLLAAYVMSGSSADLSLEKAANVQWDEMADITGSSPIIEVKQDEDGSFSIRDVEETNMITLLVKLALITVSGLYPLAIPITMTLWYMWQVKTQRSGALWDVPSPAATQKAALSEGVYRIMQRGLFGKTQVGVGIHMEGVFHTMWHVTRGSVICHETGRLEPSWADVRNDMISYGGGWRLGDKWDKEEDVQVLAIEPGKNPKHVQTKPGLFKTLTGEIGAVTLDFKPGTSGSPIINRKGKVIGLYGNGVVTKSGDYVSAITQAERIGEPDYEVDEDIFRKKRLTIMDLHPGAGKTKRILPSIVREALKRRLRTLILAPTRVVAAEMEEALRGLPIRYQTPAVKSEHTGREIVDLMCHATFTTRLLSSTRVPNYNLIVMDEAHFTDPSSVAARGYISTRVEMGEAAAIFMTATPPGATDPFPQSNSPIEDIEREIPERSWNTGFDWITDYQGKTVWFVPSIKAGNDIANCLRKSGKKVIQLSRKTFDTEYPKTKLTDWDFVVTTDISEMGANFRAGRVIDPRRCLKPVILTDGPERVILAGPIPVTPASAAQRRGRIGRNPAQEDDQYVFSGDPLKNDEDHAHWTEAKMLLDNIYTPEGIIPTLFGPEREKTQAIDGEFRLRGEQRKTFVELMRRGDLPVWLSYKVASAGISYKDREWCFTGERNNQILEENMEVEIWTREGEKKKLRPKWLDARVYADPMALKDFKEFASGRKSITLDILTEIASLPTYLSSRAKLALDNIVMLHTTERGGRAYQHALNELPESLETLMLVALLGAMTAGIFLFFMQGKGIGKLSMGLITIAVASGLLWVAEIQPQWIAASIILEFFLMVLLIPEPEKQRTPQDNQLIYVILTILTIIGLIAANEMGLIEKTKTDFGFYQVKTETTILDVDLRPASAWTLYAVATTILTPMLRHTIENTSANLSLAAIANQAAVLMGLGKGWPLHRMDLGVPLLAMGCYSQVNPTTLTASLVMLLVHYAIIGPGLQAKATREAQKRTAAGIMKNPTVDGITVIDLEPISYDPKFEKQLGQVMLLVLCAGQLLLMRTTWAFCEVLTLATGPILTLWEGNPGRFWNTTIAVSTANIFRGSYLAGAGLAFSLIKNAQTPRRGTGTAGETLGEKWKRQLNSLDRKEFEEYKRSGILEVDRTEAKSALKDGSKIKHAVSRGSSKIRWIVERGMVKPKGKVVDLGCGRGGWSYYMATLKNVTEVKGYTKGGPGHEEPIPMATYGWNLVKLHSGVDVFYKPTEQVDTLLCDIGESSSNPTIEEGRTLRVLKMVEPWLSSKPEFCIKVLNPYMPTVIEELEKLQRKHGGNLVRCPLSRNSTHEMYWVSGASGNIVSSVNTTSKMLLNRFTTRHRKPTYEKDVDLGAGTRSVSTEIEKPDMTIIGRRLQRLQEEHKETWHYDQENPYRTWAYHGSYEAPSTGSASSMVNGVVKLLTKPWDVIPMVTQLAMTDTTPFGQQRVFKEKVDTRTPQPKPGTRMVMTTTANWLWALLGKKKNPRLCTREEFISKVRSNAAIGAVFQEEQGWTSASEAVNDSRFWELVDKERALHQEGKCESCVYNMMGKREKKLGEFGRAKGSRAIWYMWLGARFLEFEALGFLNEDHWFGRENSWSGVEGEGLHRLGYILEEIDKKDGDLMYADDTAGWDTRITEDDLQNEELITEQMAPHHKILAKAIFKLTYQNKVVKVLRPTPRGAVMDIISRKDQRGSGQVGTYGLNTFTNMEVQLIRQMEAEGVITQDDMQNPKGLKERVEKWLRECGVDRLKRMAISGDDCVVKPLDERFGTSLLFLNDMGKVRKDIPQWEPSKGWKNWQEVPFCSHHFHKIFMKDGRSLVVPCRNQDELIGRARISQGAGWSLRETACLGKAYAQMWSLMYFHRRDLRLASMAICSAVPTEWFPTSRTTWSIHAHHQWMTTEDMLKVWNRVWIEDNPNMIDKTPVHSWEDIPYLGKREDLWCGSLIGLSSRATWAKNIHTAITQVRNLIGKEEYVDYMSVMKRYSAPSESEGVL

SEQ ID NO: 5250 - protein, 3288 aa, Artificial Sequence
  derived and/or modified protein sequence (wt) from DENV-4__KJ579241__SS-prME
STITLLCLIPTVMAFHLSTRDGEPLMIVAKHERGRPLLFKTTEGINKCTLIAMDLGEMCEDTVTYKCPLLVNTEPEDIDCWCNLTSTWVMYGTCTQSGERRREKRSVALTPHSGMGLETRAETWMSSEGAWKHAQRVESWILRNPGFALLAGFMAYMIGQTGIQRTVFFVLMMLVAPSYGMRCVGVGNRDFVEGVSGGAWVDLVLEHGGCVTTMAQGKPTLDFELTKTTAKEVALLRTYCIEALISNITTATRCPTQGEPYLKEEQDQQYICRRDVVDRGWGNGCGLFGKGGVVTCAKFSCSGKITGNLVQIENLEYTVVVTVHNGDTHAVGNDTSNHGVTATITPRSPSVEVKLPDYGELTLDCEPRSGIDFNEMILMKMKKKTWLVHKQWFLDLPLPWTTGADTSEVHWNYKERMVTFKIPHAKRQDVTVLGSQEGAMHSALAGATEVDSGDGNHMFAGHLKCKVRMEKLRIKGMSYTMCSGKFSIDKEMAETQHGTTVVKVKYEGAGAPCKVPIEIRDVNKEKVVGRVISATPLAENTNSVTNIELEPPFGDSYIVIGVGNSALTLHWFRKGSSIGKMFESTYRGAKRMAILGETAWDFGSVGGLFTSLGKAVHQVFGSVYTTMFGGVSWMIRILIGFLVLWIGTNSRNTSMAMTCIAVGGITLFLGFTVQADMGCVVSWSGRELKCGSGIFVVDNVHTWTEQYKFQPESPARLASAILNAHKDGVCGIRSTTRLENVMWKQITNELNYVLWEGGHDLTVVAGDVKGVLTKGKRALTPPASDLKYSWKTWGKAKIFTPEARNSTFLIDGPDTSECPNERRAWNSFEVEDYGFGMFTTNIWMKFREGSSEVCDHRLMSAAIKDQKAVHADMGYWIESSKNQTWQIERASLIEVKTCLWPKTHTLWSNGVLESQMLIPKSYAGPFSQHNYRQGYATQTVGPWHLGKLEIDFGECPGTTVTIQENCDHRGPSLRTTTASGKLVTQWCCRSCTMPPLRFLGEDGCWYGMEIRPLSEKEENMVKSQVTAGQGTSETFSMGLLCLTLFVEECLRRRVTRKHMILAVVITLCAIILGGLTWMDLLRALIILGDTMSGRIGGQTHLAIMAVFKMSPGYVLGVFLRKLTSRETALMVIGMAMTTTLSIPHDLMELIDGISLGLILLKIVTQFDNTQVGTLALSLTFIRSTMSLVMAWRTIMAVLFVVTLIPLCRTSCLQKQSHWVEITALILGAQALPVYLMTLMKGASRRSWPLNEGIMAVGLVSLLGSALLKNDVPLAGPMVAGGLLLAAYVMSGSSADLSLEKAANVQWDEMADITGSSPIIEVKQDEDGSFSIRDVEETNMITLLVKLALITVSGLYPLAIPITMTLWYMWQVKTQRSGALWDVPSPAATQKAALSEGVYRIMQRGLFGKTQVGVGIHMEGVFHTMWHVTRGSVICHETGRLEPSWADVRNDMISYGGGWRLGDKWDKEEDVQVLAIEPGKNPKHVQTKPGLFKTLTGEIGAVTLDFKPGTSGSPIINRKGKVIGLYGNGVVTKSGDYVSAITQAERIGEPDYEVDEDIFRKKRLTIMDLHPGAGKTKRILPSIVREALKRRLRTLILAPTRVVAAEMEEALRGLPIRYQTPAVKSEHTGREIVDLMCHATFTTRLLSSTRVPNYNLIVMDEAHFTDPSSVAARGYISTRVEMGEAAAIFMTATPPGATDPFPQSNSPIEDIEREIPERSWNTGFDWITDYQGKTVWFVPSIKAGNDIANCLRKSGKKVIQLSRKTFDTEYPKTKLTDWDFVVTTDISEMGANFRAGRVIDPRRCLKPVILTDGPERVILAGPIPVTPASAAQRRGRIGRNPAQEDDQYVFSGDPLKNDEDHAHWTEAKMLLDNIYTPEGIIPTLFGPEREKTQAIDGEFRLRGEQRKTFVELMRRGDLPVWLSYKVASAGISYKDREWCFTGERNNQILEENMEVEIWTREGEKKKLRPKWLDARVYADPMALKDFKEFASGRKSITLDILTEIASLPTYLSSRAKLALDNIVMLHTTERGGRAYQHALNELPESLETLMLVALLGAMTAGIFLFFMQGKGIGKLSMGLITIAVASGLLWVAEIQPQWIAASIILEFFLMVLLIPEPEKQRTPQDNQLIYVILTILTIIGLIAANEMGLIEKTKTDFGFYQVKTETTILDVDLRPASAWTLYAVATTILTPMLRHTIENTSANLSLAAIANQAAVLMGLGKGWPLHRMDLGVPLLAMGCYSQVNPTTLTASLVMLLVHYAIIGPGLQAKATREAQKRTAAGIMKNPTVDGITVIDLEPISYDPKFEKQLGQVMLLVLCAGQLLLMRTTWAFCEVLTLATGPILTLWEGNPGRFWNTTIAVSTANIFRGSYLAGAGLAFSLIKNAQTPRRGTGTAGETLGEKWKRQLNSLDRKEFEEYKRSGILEVDRTEAKSALKDGSKIKHAVSRGSSKIRWIVERGMVKPKGKVVDLGCGRGGWSYYMATLKNVTEVKGYTKGGPGHEEPIPMATYGWNLVKLHSGVDVFYKPTEQVDTLLCDIGESSSNPTIEEGRTMRVLKMVEPWLSSKPEFCIKVLNPYMPTVIEELEKLQRKHGGNLVRCPLSRNSTHEMYWVSGASGNIVSSVNTTSKMLLNRFTTRHRKPTYEKDVDLGAGTRSVSTETEKPDMTIIGRRLQRLQEEHKETWHYDQENPYRTWAYHGSYEAPSTGSASSMVNGVVKLLTKPWDVIPMVTQLAMTDTTPFGQQRVFKEKVDTRTPQPKPGTRMVMTTTANWLWALLGKKKNPRLCTREEFISKVRSNAAIGAVFQEEQGWTSASEAVNDSRFWELVDKERALHQEGKCESCVYNMMGKREKKLGEFGRAKGSRAIWYMWLGARFLEFEALGFLNEDHWFGRENSWSGVEGEGLHRLGYILEEIDKKDGDLMYADDTAGWDTRITEDDLQNEELITEQMAPHHKILAKAIFKLTYQNKVVKVLRPTPRGAVMDIISRKDQRGSGQVGTYGLNTFTNMEVQLIRQMEAEGVITQDDMQNPKGLKERVEKWLRECGVDRLKRMAISGDDCVVKPLDERFGTSLLFLNDMGKVRKDIPQWEPSKGWKNWQEVPFCSHHFHKIFMKDGRSLVVPCRNQDELIGRARISQGAGWSLRETACLGKAYAQMWSLMYFHRRDLRLASMAICSAVPTEWFPTSRTTWSIHAHHQWMTTEDMLKVWNRVWIEDNPNMIDKTPVHSWEDIPYLGKREDLWCGSLIGLSSRATWAKNIHTAITQVRNLIGKEEYVDYMPVMKRYSAPSESEGVL

SEQ ID NO: 5251 - protein, 3288 aa, Artificial Sequence
  derived and/or modified protein sequence (wt) from DENV-4__KJ596672__SS-prME
STITLLCLIPTVMAFHLSTRDGEPLMIVAKHERGRPLLFKTTEGINKCTLIAMDLGEMCEDTVTYKCPLLVNTEPEDIDCWCNLTSTWVMYGTCTQSGERRREKRSVALTPHSGMGLETRAETWMSSEGAWKHAQRVESWILRNPGFALLAGFMAYMIGQTGIQRTVFFVLMMLVAPSYGMRCVGVGNRDFVEGVSGGAWVDLVLEHGGCVTTMAQGKPTLDFELTKTTAKEVALLRTYCIEALISNITTATRCPTQGEPYLKEEQDQQYICRRDVVDRGWGNGCGLFGKGGVVTCAKFSCSGKITGNLVQIENLEYTVVVTVHNGDTHAVGNDTSNHGVTATITPRSPSVEVKLPDYGELTLDCEPRSGIDFNEMILMKMKKKTWLVHKQWFLDLPLPWTTGADTSEVHWNYKERMVTFKVPHAKRQDVTVLGSQEGAMHSALAGATEVDSGDGNHMFAGHLKCKVRMEKLRIKGMSYTMCSGKFSIDKEMAETQHGTTVVKVKYEGAGAPCKVPIEIRDVNKEKVVGRVISATPLAENTNSVTNIELEPPFGDSYIVIGVGNSALTLHWFRKGSSIGKMFESTYRGAKRMAILGETAWDFGSVGGLFTSLGKAVHQVFGSVYTTMFGGVSWMIRILIGFLVLWIGTNSRNTSMAMTCIAVGGITLFLGFTVQADMGCVVSWSGRELKCGSGIFVVDNVHTWTEQYKFQPESPARLASAILNAHKDGVCGIRSTTRLENVMWKQITNELNYVLWEGGHDLTVVAGDVKGVLTKGKRALTPPASDLKYSWKTWGKAKIFTPEARNSTFLIDGPDTSECPNERRAWNSFEVEDYGFGMFTTNIWMKFREGSSEVCDHRLMSAAIKDQKAVHADMGYWIESSKNQTWQIERASLIEVKTCLWPKTHTLWSNGVLESQMLIPKSYAGPFSQHNYRQGYATQTVGPWHLGKLEIDFGECPGTTVTIQENCDHRGPSLRTTTASGKLVTQWCCRSCTMPPLRFLGEDGCWYGMEIRPLSEKEENMVKSQVTAGQGTSETFSMGLLCLTLFVEECLRRRVTRKHMILAVVITLCAIILGGLTWMDLLRALIMLGDTMSGRIGGQTHLAIIAVFKMSPGYVLGVFLRKLTSRETALMVIGMAMTTTLSIPHDLMELIDGISLGLILLKIVTQFDNTQVGTLALSLTFIRSTMSLVMAWRTIMAVLFVVTLIPLCRTSCLQKQSHWVEITALILGAQALPVYLMTLMKGASRRSWPLNEGIMAVGLVSLLGSALLKNDVPLAGPMVAGGLLLAAYVMSGSSADLSLEKAANVQWDEMADITGSSPIIEVKQDEDGSFSIRDVEETNMITLLVKLALITVSGLYPLAIPITMTLWYMWQVKTQRSGALWDVPSPAATQKAALSEGVYRIMQRGLFGKTQVGVGIHMEGVFHTMWHVTRGSVICHETGRLEPSWADVRNDMISYGGGWRLGDKWDKEEDVQVLAIEPGKNPKHVQTKPGLFKTLTGEIGAVTLDFKPGTSGSPIINRKGKVIGLYGNGVVTKSGDYVSAITQAERIGEPDYEVDEDIFRKKRLTIMDLHPGAGKTKRILPSIVREALKRRLRTLILAPTRVVAAEMEEALRGLPIRYQTPAVKSEHTGREIVDLMCHATFTTRLLSSTRVPNYNLIVMDEAHFTDPSSIAARGYISTRVEMGEAAAIFMTATPPGATDPFPQSNSPIEDIEREIPERSWNTGFDWITDYQGKTVWFVPSIKAGNDIANCLRKSGKKVIQLSRKTFDTEYPKTKLTDWDFVVTTDISEMGANFRAGRVIDPRRCLKPVILTDGPERVILAGPIPVTPASAAQRRGRIGRNPAQEDDQYVFSGDPLKNDEDHAHWTEAKMLLDNIYTPEGIIPTLFGPEREKTQAIDGEFRLRGEQRKTFVELMRRGDLPVWLSYKVASAGISYKDREWCFTGERNNQILEENMEVEIWTREGEKKKLRPKWLDARVYADPMALKDFKEFASGRKSITLDILTEIASLPTYLSSRAKLALDNIVMLHTTERGGRAYQHALNELPESLETLMLVALLGAMTAGIFLFFMQGKGIGKLSMGLITIAVASGLLWVAEIQPQWIAASIILEFFLMVLLIPEPEKQRTPQDNQLIYVILTILTIIGLIAANEMGLIEKTKTDFGFYQVKTETTILDVDLRPASAWTLYAVATTILTPMLRHTIENTSANLSLAAIANQAAVLMGLGKGWPLHRMDLGVPLLAMGCYSQVNPTTLTASLVMLLVHYAIIGPGLQAKATREAQKRTAAGIMKNPTVDGITVIDLEPISYDPKFEKQLGQVMLLVLCAGQLLLMRTTWAFCEVLTLATGPILTLWEGNPGRFWNTTIAVSTANIFRGSYLAGAGLAFSLIKNAQTPRRGTGTAGETLGEKWKRQLNSLDRKEFEEYKRSGILEVDRTEAKSALKDGSKIKHAVSRGSSKIRWIVERGMVKPKGKVVDLGCGRGGWSYYMATLKNVTEVKGYTKGGPGHEEPIPMATYGWNLVKLHSGVDVFYKPTEQVDTLLCDIGESSSNPTIEEGRTLRVLKMVEPWLSSKPEFCIKVLNPYMPTVIEELEKLQRKHGGNLVRCPLSRNSTHEMYWVSGASGNIVSSVNTTSKMLLNRFTTRHRKPTYEKDVDLGAGTRSVSTEIEKPDMTIIGRRLQRLQEEHKETWHYDQENPYRTWAYHGSYEAPSTGSASSMVNGVVKLLTKPWDVIPMVTQLAMTDTTPFGQQRVFKEKVDTRTPQPKPGTRMVMTTTANWLWALLGKKKNPRLCTREEFISKVRSNAAIGAVFQEEQGWTSASEAVNDSRFWELVDKERALHQEGKCESCVYNMMGKREKKLGEFGRAKGSRAIWYMWLGARFLEFEALGFLNEDHWFGRENSWSGVEGEGLHRLGYILEEIDKKDGDLMYADDTAGWDTRITEDDLQNEELITEQMAPHHKILAKAIFKLTYQNKVVKVLRPTPRGAVMDIISRKDQRGSGQVGTYGLNTFTNMEVQLIRQMEAEGVITQDDMQNPKGLKERVEKWLRECGVDRLKRMAISGDDCVVKPLDERFGTSLLFLNDMGKVRKDIPQWEPSKGWKNWQEVPFCSHHFHKIFMKDGRSLVVPCRNQDELIGRARISQGAGWSLRETACLGKAYAQMWSLMYFHRRDLRLASMAICSAVPTEWFPTSRTTWSIHAHHQWMTTEDMLKVWNRVWIEDNPNMIDKTPVHSWEDIPYLGKREDLWCGSLIGLSSRATWAKNIHTAITQVRNLIGKEEYVDYMSVMKRYSAPSESEGVL

SEQ ID NO: 5252 - protein, 3288 aa, Artificial Sequence
  derived and/or modified protein sequence (wt) from DENV-4__KJ579242__SS-prME
STITLLCLIPTVMAFHLSTRDGEPLMIVAKHERGRPLLFKTTEGINKCTLIAMDLGEMCEDTVTYKCPLLVNTEPEDIDCWCNLTSTWVMYGTCTQSGERRREKRSVALTPHSGMGLETRAETWMSSEGAWKHAQRVESWILRNPGFALLAGFMAYMIGQTGIQRTVFFVLMMLVAPSYGMRCVGVGNRDFVEGVSGGAWVDLVLEHGGCVTTMAQGKPTLDFELTKTTAKEVALLRTYCIEALISNITTATRCPTQGEPYLKEEQDQQYICRRDVVDRGWGNGCGLFGKGGVVTCAKFSCSGKITGNLVQIENLEYTVVVTVHNGDTHAVGNDTSNHGVTATITPRSPSVEVKLPDYGELTLDCEPRSGIDFNEMILMKMKKKTWLVHKQWFLDLPLPWTTGADTSEVHWNYKERMVTFKVPHAKRQDVTVLGSQEGAMHSALAGATEVDSGDGNHMFAGHLKCKVRMEKLRIKGMSYTMCSGKFSIDKEMAETQHGTTVVKVKYEGAGAPCKVPIEIRDVNKEKVVGRVISATPLAENTNSVTNIELEPPFGDSYIVIGVGNSALTLHWFRKGSSIGKMFESTYRGAKRMAILGETAWDFGSVGGLFTSLGKAVHQVFGSVYTTMFGGVSWMIRILIGFLVLWIGTNSRNTSMAMTCIAVGGITLFLGFTVQADMGCVVSWSGRELKCGSGIFVVDNVHTWTEQYKFQPESPARLASAILNAHKDGVCGIRSTTRLENVMWKQITNELNYVLWEGGHDLTVVAGDVKGVLTKGKRALTPPASDLKYSWKTWGKAKIFTPEARNSTFLIDGPDTSECPNERRAWNSFEVEDYGFGMFTTNIWMKFREGSSEVCDHRLMSAAIKDQKAVHADMGYWIESSKNQTWQIERASLIEVKTCLWPKTHTLWSNGVLESQMLIPKSYAGPFSQHNYRQGYATQTVGPWHLGKLEIDFGECPGTTVTIQENCDHRGPSLRTTTASGKLVTQWCCRSCTMPPLRFLGEDGCWYGMEIRPLSEKEENMVKSQVTAGQGTSETFSMGLLCLTLFVEECLRRRVTRKHMILAVVITLCAIILGGLTWMDLLRALIILGDTMSGRIGGQTHLAIMAVFKMSPGYVLGVFLRKLTSRETALMVIGMAMTTTLSIPHDLMELIDGISLGLILLKIVTQFDNTQVGTLALSLTFIRSTMSLVMAWRTIMAVLFVVTLIPLCRTSCLQKQSHWVEITALILGAQALPVYLMTLMKGASRRSWPLNEGIMAVGLVSLLGSALLKNDVPLAGPMVAGGLLLAAYVMSGSSADLSLEKAANVQWDEMADITGSSPIIEVKQDEDGSFSIRDVEETNMITLLVKLALITVSGLYPLAIPITMTLWYMWQVKTQRSGALWDVPSPAATQKAALSEGVYRIMQRGLFGKTQVGVGIHMEGVFHTMWHVTRGSVICHETGRLEPSWADVRNDMISYGGGWRLGDKWDKEEDVQVLAIEPGKNPKHVQTKPGLFKTLTGEIGAVTLDFKPGTSGSPIINRKGKVIGLYGNGVVTKSGDYVSAITQAERIGEPDYEVDEDIFRKKRLTIMDLHPGAGKTKRILPSIVREALKRRLRTLILAPTRVVAAEMEEALRGLPIRYQTPAVKSEHTGREIVDLMCHATFTTRLLSSTRVPNYNLIVMDEAHFTDPSSVAARGYISTRVEMGEAAAIFMTATPPGATDPFPQSNSPIEDIEREIPERSWNTGFDWITDYQGKTVWFVPSIKAGNDIANCLRKSGKKVIQLSRKTFDTEYPKTKLTDWDFVVTTDISEMGANFRAGRVIDPRRCLKPVILTDGPERVILAGPIPVTPASAAQRRGRIGRNPAQEDDQYVFSGDPLKNDEDHAHWTEAKMLLDNIYTPEGIIPTLFGPEREKTQAIDGEFRLRGEQRKTFVELMRRGDLPVWLSYKVASAGISYKDREWCFTGERNNQILEENMEVEIWTREGEKKKLRPKWLDARVYADPMALKDFKEFASGRKSITLDILTEIASLPTYLSSRAKLALDNIVMLHTTERGGRAYQHALNELPESLETLMLVALLGAMTAGIFLFFMQGKGIGKLSMGLITIAVASGLLWVAEIQPQWIAASIILEFFLMVLLIPEPEKQRTPQDNQLIYVILTILTIIGLIAANEMGLIEKTKTDFGFYQVKTETTILDVDLRPASAWTLYAVATTILTPMLRHTIENTSANLSLAAIANQAAVLMGLGKGWPLHRMDLGVPLLAMGCYSQVNPTTLTASLVMLLVHYAIIGPGLQAKATREAQKRTAAGIMKNPTVDGITVIDLEPISYDPKFEKQLGQVMLLVLCAGQLLLMRTTWAFCEVLTLATGPILTLWEGNPGRFWNTTIAVSTANIFRGSYLAGAGLVFSLIKNAQTPRRGTGTAGETLGEKWKRQLNSLDRKEFEEYKRSGILEVDRTEAKSALKDGSKIKHAVSRGSSKIRWIVERGMVKPKGKVVDLGCGRGGWSYYMATLKNVTEVKGYTKGGPGHEEPIPMATYGWNLVKLHSGVDVFYKPTEQVDTLLCDIGESSSNPTIEEGRTMRVLKMVEPWLSSKPEFCIKVLNPYMPTVIEELEKLQRKHGGNLVRCPLSRNSTHEMYWVSGASGNIVSSVNTTSKMLLNRFTTRHRKPTYEKDVDLGAGTRSVSTETEKPDMTIIGRRLQRLQEEHKETWHYDQENPYRTWAYHGSYEAPSTGSASSMVNGVVKLLTKPWDVIPMVTQLAMTDTTPFGQQRVFKEKVDTRTPQPKPGTRMVMTTTANWLWALLGKKKNPRLCTREEFISKVRSNAAIGAVFQEEQGWTSASEAVNDSRFWELVDKERALHQEGKCESCVYNMMGKREKKLGEFGRAKGSRAIWYMWLGARFLEFEALGFLNEDHWFGRENSWSGVEGEGLHRLGYILEEIDKKDGDLMYADDTAGWDTRITEDDLQNEELITEQMAPHHKILAKAIFKLTYQNKVVKVLRPTPRGAVMDIISRKDQRGSGQVGTYGLNTFTNMEVQLIRQMEAEGVITQDDMQNPKGLKERVEKWLRECGVDRLKRMAISGDDCVVKPLDERFGTSLLFLNDMGKVRKDIPQWEPSKGWKNWQEVPFCSHHFHKIFMKDGRSLVVPCRNQDELIGRARISQGAGWSLRETACLGKAYAQMWSLMYFHRRDLRLASMAICSAVPTEWFPTSRTTWSIHAHHQWMTTEDMLKVWNRVWIEDNPNMIDKTPVHSWEDIPYLGKREDLWCGSLIGLSSRATWAKNIHTAITQVRNLIGKEEYVDYMPVMKRYSAPSESEGVL

SEQ ID NO: 5253 - protein, 3288 aa, Artificial Sequence
  derived and/or modified protein sequence (wt) from DENV-4__GQ398256__SS-prME
STMTLLCLIPTVMAFHLSTRDGEPLMIVAKHERGRPLLFKTTEGINKCTLIAMDLGEMCEDTVTYKCPLLVNTEPEDIDCWCNLTSTWVMYGTCTQNGERRREKRSVALTPHSGMGLETRAETWMSSEGAWKHAQRVESWILRNPGFALLAGFMAYMIGQTGIQRTVFFVLMMLVAPSYGMRCVGVGNRDFVEGVSGGAWVDLVLEHGGCVTTMAQGKPTLDFELTKTTAKEVALLRTYCIEASISNITTATRCPTQGEPYLKEEQDQQYICRRDVVDRGWGNGCGLFGKGGVVTCAKFLCSGKITGNLVQIENLEYTVAVTVHNGDTHAVGNDTSSHGVTATITPRSPSVEVKLPDYGELTLDCEPRSGIDFNEMILMKMKKKTWLVHKQWFLDLPLPWTAGADTSEVHWNHKERMVTFKVPHAKRQDVTVLGSQEGAMHSALAGATEVDSGDGNHMFAGHLKCKVRMEKLRIKGMSYTMCSGKFSIDKEMAETQHGTTVVKVKYEGAGAPCKVPIEIRDVNKEKVVGRIISSTPFAENTNSVTNIELEPPFGDSYIVIGVGESALTLHWFRKGSSIGKMFESTYRGAKRMAILGETAWDFGSVGGLFTSLGKAVHQVFGSVYTTMFGGVSWMVRILIGFLVLWIGTNSRNTSMAMTCIAVGGITLFLGFTVQADMGCVVSWNGKELKCGSGIFVVDNVHTWTEQYKFQPESPARLASAILNAHKDGVCGIRSTTRLENVMWKQITNELNYVLWEGGHDLTVVAGDVKGVLTKGKRALTPPVNDLKYSWKTWGKAKIFTPEARNSTFLIDGPDTSECPNERRAWNFFEVEDYGFGMFTTNIWMKFREGSSEVCDHRLMSAAIKDQKAVHADMGYWIESSKNQTWQIEKASLIEVKTCLWPKTHTLWSNGVLESQMLIPRSYAGPFSQHNYRQGYATQTVGPWHLGKLEIDFGECPGTTVAIREDCDHRGPSLRTTTASGKLVTQWCCRSCTMPPLRFLGEDGCWYGMEIRPLSEKEENMVKSQVTAGQGTSETFSMGLLCLTLFVEECLRRRVTRKHMILVVVITFCAIILGGLTWMDLLRALIMLGDTMSGRIGGQIHLAIMAVFKMSPGYVLGVFLRKLTSRETALMVIGMAMTTVFSIPHDLMELIDGISLGLILLKIVTHFDNTQVGTLALSLTFLRSTIPLVMAWRTIMAVFFVVTLIPLCRTSCLQKQSHWVEITALILGAQALPVYLMTLMKGASRRSWPLNEGIMAVGLVSLLGSALLKNDVPLAGPMVAGGLLLAAYVMSGSSADLSLEKAANVQWDEMADITGSSPIIEVKQDEDGSFSIRDVEETNMITLLVKLALITVSGLYPLAIPVTMALWYIWQVKTQRSGALWDVPSPAATQKATLSEGVYRIMQRGLFGKTQVGVGIHMEGVFHTMWHVTRGSVICHETGRLEPSWADVRNDMISYGGGWRLGDKWDKEEDVQVLAIEPGKNPKHVQTKPGLFKTLTGEIGAVTLDFKPGTSGSPIINKKGKVIGLYGNGVVTKSGDYVSAITQAERIGEPDYEVDEDIFRKKRLTIMDLHPGAGKTKRILPSIVREALKRRLRTLILAPTRVVAAEMEEALRGLPIRYQTPAVKSEHTGREIVDLMCHATFTTRLLSSTRVPNYNLIVMDEAHFTDPCSVAARGYISTRVEMGEAAAIFMTATPPGATDPFPQSNSPIEDIEREIPERSWNTGFDWITDYQGKTVWFVPSIKAGNDIANCLRKSGKRVIQLSRKTFDTEYPKTKLTDWDFVVTTDISEMGANFRAGRVIDPRRCLKPVILTDGPERVILAGPIPVTPASAAQRRGRIGRNPAQEDDQYVFSGDPLKNDEDHAHWTEAKMLLDNIYTPEGIIPTLFGPEREKTQAIDGEFRLRGEQRKTFVELMKRGDLPVWLSYKVASAGISYKDREWCFTGERNNQILEENMEVEIWTKEGEKKKLRPKWLDARVYADPMALKDFKEFASGRKSITLDILTEIASLPTYLSSKAKLALDNIVMLHTTEKGGRAYQHALNELPESLETLMLVALLGAMTAGIFLFFMQGKGIGKLSMGLIAIAVASGLLWVAEIQPQWIAASIILEFFLMVLLIPEPEKQRTPQDNQLIYVILTILTIIGLIAANEMGLIEKTKTDFGFYQVKTETTILDVDLRPASAWTLYAVATTILTPMLRHTIENTSANLSLAAIANQAAVLMGLGKGWPLHRMDLGVPLLAIGCYSQVNPTTLTASLVMLLVHYAIIGPGLQAKATREAQKRTAAGIMKNPTVDGITVIDLEPISYDPKFEKQLGQVMLLVLCVGQLLLMRTTWALCEVLTLATGPAMTLWEGNPGRFWNTTIAVSTANIFRGSYLAGAGLAFSLIKNAQTPRRGTGTTGETLGEKWKRQLNSLDRKEFEEYKRSGILEVDRTEAKSALKDGSKIKHAVSRGSSKIRWIVERGMVKPKGKVVDLGCGRGGWSYYMATLKNVTEVKGYTKGGPGHEEPIPMATYGWNLVKLHSGVDVFYKPTEQVDTLLCDIGESSSNPTIEEGRTLRVLKMVEPWLSSKPEFCIKVLNPYMPTVIEELEKLQRRYGGSLVRCPLSRNSTHEMYWVSGASGNIVSSVNTISKMLLNRFTTRHRKPTYEKDVDLGAGTRSVSTETEKPDMTVIGRRLQRLQEEHKETWHYDQENPYRTWAYHGSYEAPSTGSASSMVNGIVKLLTKPWDVIPMVTQLAMTDTTPFGQQRVFKEKVDTRTPQPKPGTRMIMTTTANWLWALLGKKKSPRLCTREEFISKVRSNAAIGAVFQEEQGWTSASEAVNDSRFWELVNKERALHQEGKCESCVYNMMGKREKKLGEFGRAKGSRAIWYMWLGARFLEFEALGFLNEDHWFSRENSWSGVEGEGLHRLGYILEDIDKQDGDLIYADDTAGWDTRITEDDLLNEELITEQMAPHHKTLAKAIFKLTYQNKVVKVLRPTPKGAVMDIISRKDQRGSGQVGTYGLNTFTNMEVQLIRQMEAEGVITQDDMQNPKGLKERVEKWLTECGVDRLKRMAISGDDCVVKPLDERFSASLLFLNDMGKVRKDIPQWEPSKGWKNWQEVPFCSHHFHKIFMKDGRSLVVPCRNQDELIGRARISQGAGWSLRETACLGKAYAQMWSLMYFHRRDLRLASMAICSAVPTEWFPTSRTTWSIHAHHQWMTTEDMLKVWNRVWIEDNPNMTDKTPVHSWEDIPYLGKREDLWCGSLIGLSSRATWAKNIHTAITQVRNLIGKEEYVDYMPVMKRYSAPSESEGVL

SEQ ID NO: 5254 - protein, 3288 aa, Artificial Sequence
  derived and/or modified protein sequence (wt) from DENV-4__KC333651__SS-prME
STMTLLCLIPTVMAFHLSTRDGEPLMIVAKHERGRPLLFKTTEGINKCTLIAMDLGEMCEDTVTYKCPLLVNTEPEDIDCWCNLTSTWVMYGTCTQNGERRREKRSVALTPHSGMGLETRAETWMSSEGAWKHAQRVESWILRNPGFALLAGFMAYMIGQTGIQRIVFFVLMMLVAPSYGMRCVGVGNRDFVEGVSGGAWVDLVLEHGGCVTTMAQGKPTLDFELTKTTAKEVALLRTYCIEASISNITTATRCPTQGEPYLKEEQDQQYICRRDVVDRGWGNGCGLFGKGGVVTCAKFLCSGKITGNLVQIENLEYTVVVTVHNGDTHAVGNDTSNHGVTATITPRSPSVEVKLPDYGELTLDCEPRSGIDFNEMILMKMKKKTWLVHKQWFLDLPLPWTAGADTSEVHWNHKERMVTFKVPHAKRQDVTVLGSQEGAMHSALAGATEVDSGDGNHMFAGHLKCKVRMEKLRIKGMSYTMCSGKFSIDKEMAETQHGTTVVKVKYEGAGAPCKVPIEIRDVNKEKVVGRIISSTPFAENTNSVTNIELEPPFGDSYIVIGVGESALTLHWFRKGSSIGKMFESTYRGAKRMAILGETAWDFGSVGGLFTSLGKAVHQVFGSVYTTMFGGVSWMVRILIGFLVLWIGTNSRNTSMAMTCIAVGGITLFLGFTVQADMGCVVSWNGKELKCGSGIFVVDNVHTWTEQYKFQPESPARLASAILNAHKDGVCGIRSTTRLENVMWKQITNELNYVLWEGGHDLTVVAGDVKGVLTKGKRALTPPVNDLKYSWKTWGKAKIFTPEARNSTFLIDGPDTSECPNERRAWNFFEVEDYGFGMFTTNIWMKFREGSSEVCDHRLMSAAIKDQKAVHADMGYWIESSKNQTWQIEKASLIEVKTCLWPKTHTLWSNGVLESQMLIPRSYAGPFSQHNYRQGYATQTVGPWHLGKLEIDFGECPGTTVAIREDCDHRGPSLRTTTASGKLVTQWCCRSCTMPPLRFLGEDGCWYGMEIRPLSEKEENMVKSQVTAGQGTSETFSMGLLCLTLFVEECLRRRVTRKHMILVVVITFCAIILGGLTWMDLLRALIMLGDTMSGRIGGQIHLAIMAVFKMSPGYVLGVFLRKLTSRETALMVIGMAMTTVFSIPHDLMELIDGISLGLILLKIVTHFDNTQVGTLALSLTFLRSTIPLVMAWRTIMAVFFVVTLIPLCRTSCLQKHSHWVEITALILGAQALPVYLMTLMKGASRRSWPLNEGIMAVGLVSLLGSALLKNDVPLAGPMVAGGLLLAAYVMSGSSADLLLEKAANVQWDEMADITGSSPIIEVKQDEDGSFSIRDVEETNMMTLLVKLALITVSGLYPLAIPVTMALWYIWQVKTQRSGALWDVPSPAATQKATLSEGVYRIMQRGLFGKTQVGVGIHMEGVFHTMWHVTRGSVICHETGRLEPSWADVRNDMISYGGGWRLGDKWDKEEDVQVLAIEPGKNPKHVQTKPGLFKTLTGEIGAVTLDFKPGTSGSPIINKKGKVIGLYGNGVVTKSGDYVSAITQAERIGEPDYEVDEDIFRKKRLTIMDLHPGAGKTKRILPSIVREALKRRLRTLILAPTRVVAAEMEEALRGLPIRYQTPAVKSEHTGREIVDLMCHATFTTRLLSSTRVPNYNLIVMDEAHFTDPCSVAARGYISTRVEMGEAAAIFMTATPPGATDPFPQSNSPIEDIEREIPERSWNTGFDWITDYQGKTVWFVPSIKAGNDIANCLRKSGKRVIQLSRKTFDTEYPKTKLTDWDFVVTTDISEMGANFRAGRVIDPRRCLKPVILTDGPERVILAGPIPVTPASAAQRRGRIGRNPAQEDDQYVFSGDPLKNDEDHAHWTEAKMLLDNIYTPEGIIPTLFGPEREKTQAIDGEFRLRGEQRKTFVELMKRGDLPVWLSYKVASAGISYKDREWCFTGERNNQILEENMEVEIWTKEGEKKKLRPKWLDARVYADPMALKDFKEFASGRKSITLDILTEIASLPTYLSSKAKLALDNIVMLHTTEKGGRAYQHALNELPESLETLMLVALLGAMTAGIFLFFMQGKGIGKLSMGLIAIAVASGLLWVAEIQPQWIAASIILEFFLMVLLIPEPEKQRTPQDNQLIYVILTILTIIGLIAANEMGLIEKTKTDFGFYQVKTETTILDVDLRPASAWTLYAVATTILTPMLRHTIENTSANLSLAAIANQAAVLMGLGKGWPLHRMDLGVPLLAIGCYSQVNPTTLTASLVMLLVHYAIIGPGLQAKATREAQKRTAAGIMKNPTVDGITVIDLEPISYDPKFEKQLGQVMLLVLCAGQLLLMRTTWALCEVLTLATGPAMTLWEGNPGRFWNTTIAVSTANIFRGSYLAGAGLAFSLIKNAQTPRRGTGTTGETLGEKWKRQLNSLDRKEFEEYKRSGILEVDRTEAKSALKDGSKIKHAVSRGSSKIRWIVERGMVKPKGKVVDLGCGRGGWSYYMATLKNVTEVKGYTKGGPGHEEPIPMATYGWNLVKLHSGVDVFYKPTEQVDTLLCDIGESSSNPTIEEGRTLRVLKMVEPWLSSKPEFCIKVLNPYMPTVIEELEKLQRRYGGSLVRCPLSRNSTHEMYWVSGASGNIVSSVNTISKMLLNRFTTRHRKPTYEKDVDLGAGTRSVSTETEKPDMTVIGRRLQRLQEEHKETWHYDQENPYRTWAYHGSYEAPSTGSASSMVNGVVKLLTKPWDVIPMVTQLAMTDTTPFGQQRVFKEKVDTRTPQPKPGTRMIMTTTANWLWALLGKKKSPRLCTREEFISKVRSNAAIGAVFQEEQGWTSASEAVNDSRFWELVDKERALHQEGKCESCVYNMMGKREKKLGEFGRAKGSRAIWYMWLGARFLEFEALGFLNEDHWFSRENSWSGVEGEGLHRLGYILEDIDKQEGDLIYADDTAGWDTRITEDDLLNEELITEQMAPHHKTLAKAIFKLTYQNKVVKVLRPTPKGAVMDIISRKDQRGSGQVGTYGLNTFTNMEVQLIRQMEAEGVITQDDMQNPKGLKERVEKWLTECGVDRLKRMAISGDDCVVKPLDERFSTSLLFLNDMGKVRKDIPQWEPSKGWKNWQEVPFCSHHFHKIFMKDGRSLVVPCRNQDELIGRARISQGAGWSLRETACLGKAYAQMWSLMYFHRRDLRLASMAICSAVPTEWFPTSRTTWSIHAHHQWMTTEDMLKVWNRVWIEDNPNMTDKTPVHSWEDIPYLGKREDLWCGSLIGLSSRATWAKNIHTAITQVRNLIGKEDYVDYMPVMKRYSAPSESEGVL

SEQ ID NO: 5255 - protein, 3288 aa, Artificial Sequence
  derived and/or modified protein sequence (wt) from DENV-4__JN559740__SS-prME
STITLLCLIPTVMAFHLSTRDGEPLMIVAKHERGRPLLFKTTEGINKCTLIAMDLGEMCEDTVTYKCPLLVNTEPEDIDCWCNLTSTWVMYGTCTQSGERRREKRSVALTPHSGMGLETRAETWMSSEGAWKHAQRVESWILRNPGFALLAGFMAYMIGQTGIQRTVFFVLMMLVAPSYGMRCVGVGNRDFVEGVSGGAWVDLVLEHGGCVTTMAQGKPTLDFELTKTTAKEVALLRTYCIEASISNITTATRCPTQGEPYLKEEQDQQYICRRDVVDRGWGNGCGLFGKGGVVTCAKFSCSGKITGNLVQIENLEYTVVVTVHNGDTRAVGNDISNHGVTAMITPRSPSVEVKLPDYGELTLDCEPRSGIDFNEMILMKMKKKTWLVHKQWFLDLPLPWTAGADTSEVHWNYKERMVTFKVPHAKRQDVTVLGSQEGAMHSALAGATEVDSGDGNHMFAGHLKCKVRMEKLRIKGMSYTMCSGKFSIDKEMAETQHGTTVVKVKYEGAGAPCKVPIEIRDVNKEKVVGRIISSTPLAENTNSVTNIELEPPFGDSYIVIGVGNSALTLHWFRKGSSIGKMFESTYRGAKRMAILGETAWDFGSVGGLFTSLGKAVHQVFGSVYTTMFGGVSWMIRILIGFLVLWIGTNSRNTSMAMTCIAVGGITLFLGFTVQADMGCVVSWSGKELKCGSGIFVVDNVHTWTEQYKFQPESPARLASAILNAHKDGVCGIRSTTRLENVMWKQITNELNYVLWEGGHDLTVVAGDVKGVLTKGKRALTPPVSDLKYSWKTWGKAKIFTPEARNSTFLIDGPDTSECPNERRAWNSLEVEDYGFGMFTTNIWMKFREGSSEVCDHRLMSAAIKDQKAVHADMGYWIESSKNQTWQIEKASLIEVKTCLWPKTHTLWSNGVLESQMLIPKSYAGPFSQHNYRQGYATQTVGPWHLGKLEIDFGECPGTTVTIQEDCDHRGPSLRTTTASGKLVTQWCCRSCTMPPLRFLGEDGCWYGMEIRPLSEKEENMVKSQVTAGQGTSETFSMGLLCLTLFVEECLRRRVTRKHMILVVVITLCAIILGGLTWMDLLRALIMLGDTMSGRIGGQIHLAIMAVFKMSPGYVLGVFLRKLTSRETALMVIGMAMTTVLSIPHDLMELIDGISLGLILLKIVTQFDNTQVGTLALSLTFIRSTMPLVMAWRTIMAVLFVVTLIPLCRTSCLQKQSHWVEITALILGAQALPVYLMTLMKGASRRSWPLNEGIMAVGLVSLLGSALLKNDVPLAGPMVAGGLLLAAYVMSGSSADLSLEKAANVQWDEMADITGSSPIIEVKQDEDGSFSIRDVEETNMITLLVKLALITVSGLYPLAIPVTMTLWYMWQVKTQRSGALWDVPSPAATQKAALSEGVYRIMQRGLFGKTQVGVGIHMEGVFHTMWHVTRGSVICHETGRLEPSWADVRNDMISYGGGWRLGDKWDKEEDVQVLAIEPGKNPKHVQTKPGLFKTLTGEIGAVTLDFKPGTSGSPIINRKGKVIGLYGNGVVTKSGDYVSAITQAERIGEPDYEVDEDIFRKKRLTIMDLHPGAGKTKRILPSIVREALKRRLRTLILAPTRVVAAEMEEALRGLPIRYQTPAVKSEHTGREIVDLMCHATFTTRLLSSTRVPNYNLIVMDEAHFTDPSSVAARGYISTRVEMGEAAAIFMTATPPGATDPFPQSNSPIEDIEREIPERSWNTGFDWITDYQGKTVWFVPSIKAGNDIANCLRKSGKKVIQLSRKTFDTEYPKTKLTDWDFVVTTDISEMGANFRAGRVIDPRRCLKPVILTDGPERVILAGPIPVTPASAAQRRGRIGRNPAQEDDQYVFSGDPLKNDEDHAHWTEAKMLLDNIYTPEGIIPTLFGPEREKTQAIDGEFRLRGEQRKTFVELMRRGDLPVWLSYKVASAGISYKDREWCFTGERNNQILEENMEVEIWTREGEKKKLRPRWLDARVYADPMALKDFKEFASGRKSITLDILTEIASLPTYLSSRAKLALDNIVMLHTTERGGRAYQHALNELPESLETLMLVALLGAMTAGIFLFFMQGKGIGKLSMGLITIAVASGLLWVAEIQPQWIAASIILEFFLMVLLIPEPEKQRTPQDNQLIYVILTILTIIGLIAANEMGLIEKTKTDFGFYQVKTETTILDVDLKPASAWTLYAVATTILTPMLRHTIENTSANLSLAAIANQAAVLMGLGKGWPLHRMDLGVPLLAMGCYSQVNPITLTASLVMLLVHYAIIGPGLQAKATREAQKRTAAGIMKNPTVDGITVIDLEPISYDPKFEKQLGQVMLLVLCAGQLLLMRTTWAFCEVLTLATGPILTLWEGNPGRFWNTTIAVSTANIFRGSYLAGAGLAFSLIKNVQTPRRGTGTTGETLGEKWKRQLNSLDRKEFEEYKRSGILEVDRTEAKSALKDGSKIKHAVSRGSSKIRWIVERGMVKPKGKVVDLGCGRGGWSYYMATLKNVTEVKGYTKGGPGHEEPIPMATYGWNLVKLHSGVDVFYKPTEQVDTLLCDIGESSSNPTIEEGRTLRVLKMVEPWLSSKPEFCIKVLNPYMPTVIEELEKLQRKHGGNLVRCPLSRNSTHEMYWVSGASGNIVSSVNTTSKMLLNRFTTRHRKPTYEKDVDLGAGTRSVSTETEKPDMTIIGRRLQRLQEEHKETWHYDQENPYRTWAYHGSYEAPSTGSASSMVNGVVKLLTKPWDVIPMVTQLAMTDTTPFGQQRVFKEKVDTRTPQPKPGTRMVMTTTANWLWALLGKKKNPRLCTREEFISKVRSNAAIGAVFQEEQGWTSASEAVNDSRFWELVDKERALHQEGKCESCVYNMMGKREKKLGEFGRAKGSRAIWYMWLGARFLEFEALGFLNEDHWFGRENSWSGVEGEGLHRLGYILEEIDKKDGDLMYADDTAGWDTRITEDDLQNEELITEQMAPHHKILAKAIFKLTYQNKVVKVLRPTPRGAVMDIISRKDQRGSGQVGTYGLNTFTNMEVQLIRQMEAEGVITQDDMQNPKGLKERVEKWLKECGVDRLKRMAISGDDCVVKPLDERFGTSLLFLNDMGKVRKDIPQWEPSKGWKNWQEVPFCSHHFHKIFMKDGRSLVVPCRNQDELIGRARISQGAGWSLRETACLGKAYAQMWSLMYFHRRDLRLASMAICSAVPTEWFPTSRTTWSIHAHHQWMTTEDMLKVWNRVWIEDNPNMTDKTPVHSWEDIPYLGKREDLWCGSLIGLSSRATWAKNIHTAITQVRNLIGKEEYVDYMPVMKRYSAPSESEGVL

SEQ ID NO: 5256 - protein, 3288 aa, Artificial Sequence
  derived and/or modified protein sequence (wt) from DENV-4__JN559741__SS-prME
STITLLCLIPTVMAFHLSTRDGEPLMIVAKHERGRPLLFKTTEGINKCTLIAMDLGEMCEDTVTYKCPLLVNTEPEDIDCWCNLTSTWVMYGTCTQSGERRREKRSVALTPHSGMGLETRAETWMSSEGAWKHAQRVESWILRNPGFALLAGFMAYMIGQTGIQRTVFFVLMMLVAPSYGMRCVGVGNRDFVEGVSGGAWVDLVLEHGGCVTTMAQGKPTLDFELTKTTAKEVALLRTYCIEALISNITTATRCPTQGEPYLKEEQDQQYICRRDVVDRGWGNGCGLFGKGGVVTCAKFSCSGKITGNLVQIENLEYTVVVTVHNGDTHAVGNDTSNHGVTATITPRSPSVEVKLPDYGELTLDCEPRSGIDFNEMILMKMKKKTWLVHKQWFLDLPLPWTTGADTSEVHWNYKERMVTFKVPHAKRQDVTVLGSQEGAMHSALAGATEVDSGDGNHMFAGHLKCKVRMEKLRIKGMSYTMCSGKFSIDKEMAETQHGTTVVKVKYEGAGAPCKVPIEIRDVNKEKVVGRVISATPLAENTNSVTNIELEPPFGDSYIVIGVGNSALTLHWFRKGSSIGKMFESTYRGAKRMAILGETAWDFGSVGGLFTSLGKAVHQVFGSVYTTMFGGVSWMIRILIGFLVLWIGTNSRNTSMAMTCIAVGGITLFLGFTVQADMGCVVSWSGRELKCGSGIFVVDNVHTWTEQYKFQPESPARLASAILNAHKDGVCGIRSTTRLENVMWKQITNELNYVLWEGGHDLTVVAGDVKGVLTKGKRALTPPASDLKYSWKTWGKAKIFTPEARNSTFLIDGPDTSECPNERRAWNSFEVEDYGFGMFTTNIWMKFREGSSEVCDHRLMSAAIKDQKAVHADMGYWIESSKNQTWQIERASLIEVKTCLWPKTHTLWSNGVLESQMLIPKSYAGPFSQHNYRQGYATQTVGPWHLGKLEIDFGECPGTTVTIQENCDHRGPSLRTTTASGKLVTQWCCRSCTMPPLRFLGEDGCWYGMEIRPLSEKEENMVKSQVTAGQGTSETFSMGLLCLTLFVEECLRRRVTRKHMILAVVITLCAIILGGLTWMDLLRALIMLGDTMSGRIGGQTHLAIMAVFKMSPGYVLGVFLRKLTSRETALMVIGMAMTTTLSIPHDLMELIDGISLGLILLKIVTQFDNTQVGTLALSLTFIRSTMSLVMAWRTIMAVLFVVTLIPLCRTSCLQKQSHWVEITALILGAQALPVYLMTLMKGASRRSWPLNEGIMAVGLVSLLGSALLKNDVPLAGPMVAGGLLLAAYVMSGSSADLSLEKAANVQWDEMADITGSSPIIEVKQDEDGSFSIRDVEETNMITLLVKLALITVSGLYPLAIPITMTLWYMWQVKTQRSGALWDVPSPAATQKAALSEGVYRIMQRGLFGKTQVGVGIHMEGVFHTMWHVTRGSVICHETGRLEPSWADVRNDMISYGGGWRLGDKWDKEEDVQVLAIEPGKNPKHVQTKPGLFKTLTGEIGAVTLDFKPGTSGSPIINRKGKVIGLYGNGVVTKSGDYVSAITQAERIGEPDYEVDEDIFRKKRLTIMDLHPGAGKTKRILPSIVREALKRRLRTLILAPTRVVAAEMEEALRGLPIRYQTPAVKSEHTGREIVDLMCHATFTTRLLSSTRVPNYNLIVMDEAHFTDPSSVAARGYISTRVEMGEAAAIFMTATPPGATDPFPQSNSPIEDIEREIPERSWNTGFDWITDYQGKTVWFVPSIKAGNDIANCLRKSGKKVIQLSRKTFDTEYPKTKLTDWDFVVTTDISEMGANFRAGRVIDPRRCLKPVILTDGPERVILAGPIPVTPASAAQRRGRIGRNPAQEDDQYVFSGDPLKNDEDHAHWTEAKMLLDNIYTPEGIIPTLFGPEREKTQAIDGEFRLRGEQRKTFVELMRRGDLPVWLSYKVASAGISYKDREWCFTGERNNQILEENMEVEIWTREGEKKKLRPKWLDARVYADPMALKDFKEFASGRKSITLDILTEIASLPTYLSSRAKLALDNIVMLHTTERGGRAYQHALNELPESLETLMLVALLGAMTAGIFLFFMQGKGIGKLSMGLITIAVASGLLWVAEIQPQWIAASIILEFFLMVLLIPEPEKQRTPQDNQLIYVILTILTIIGLIAANEMGLIEKTKTDFGFYQVKTETTILDVDLRPASAWTLYAVATTILTPMLRHTIENTSANLSLAAIANQAAVLMGLGKGWPLHRMDLGVPLLAMGCYSQVNPTTLTASLVMLLVHYAIIGPGLQAKATREAQKRTAAGIMKNPTVDGITVIDLEPISYDPKFEKQLGQVMLLVLCAGQLLLMRTTWAFCEVLTLATGPILTLWEGNPGRFWNTTIAVSTANIFRGSYLAGAGLAFSLIKNAQTPRRGTGTAGETLGEKWKRQLNSLDRKEFEEYKRSGILEVDRTEAKSALKDGSKIKHAVSRGSSKIRWIVERGMVKPKGKVVDLGCGRGGWSYYMATLKNVTEVKGYTKGGPGHEEPIPMATYGWNLVKLHSGVDVFYKPTEQVDTLLCDIGESSSNPTIEEGRTLRVLKMVEPWLSSKPEFCIKVLNPYMPTVIEELEKLQRKHGGNLVRCPLSRNSTHEMYWVSGASGNIVSSVNTTSKMLLNRFTTRHRKPTYEKDVDLGAGTRSVSTETEKPDMTIIGRRLQRLQEEHKETWHYDQENPYRTWAYHGSYEAPSTGSASSMVNGVVKLLTKPWDVIPMVTQLAMTDTTPFGQQRVFKEKVDTRTPQPKPGTRMVMTTTANWLWALLGKKKNPRLCTREEFISKVRSNAAIGAVFQEEQGWTSASEAVNDSRFWELVDKERALHQEGKCESCVYNMMGKREKKLGEFGRAKGSRAIWYMWLGARFLEFEALGFLNEDHWFGRENSWSGVEGEGLHRLGYILEEIDKKDGDLMYADDTAGWDTRITEDDLQNEELITEQMAPHHKILAKAIFKLTYQNKVVKVLRPTPRGAVMDIISRKDQRGSGQVGTYGLNTFTNMEVQLIRQMEAEGVITQDDMQNPKGLKERVEKWLRECGVDRLKRMAISGDDCVVKPLDERFGTSLLFLNDMGKVRKDIPQWEPSKGWKNWQEVPFCSHHFHKIFMKDGRSLVVPCRNQDELIGRARISQGAGWSLRETACLGKAYAQMWSLMYFHRRDLRLASMAICSAVPTEWFPTSRTTWSIHAHHQWMTTEDMLKVWNRVWIEDNPNMIDKTPVHSWEDIPYLGKREDLWCGSLIGLSSRATWAKNIHTAITQVRNLIGKEEYVDYMPVMKRYSAPSESEGVL

SEQ ID NO: 5257 - protein, 3288 aa, Artificial Sequence
  derived and/or modified protein sequence (wt) from DENV-4__JQ513334__SS-prME
STITLLCLIPTVMAFHLSTRDGEPLMIVAKHERGRPLLFKTTEGINKCTLIAMDLGEMCEDTVTYKCPLLVNTEPEDIDCWCNLTSTWVMYGTCTQSGERRREKRSVALTPHSGMGLETRAETWMSSEGAWKHAQRVESWILRNPGFALLAGFMAYMIGQTGIQRTVFFVLMMLVAPSYGMRCVGVGNRDFVEGVSGGAWVDLVLEHGGCVTTMAQGKPTLDFELTKTTAMEVALLRTYCIEASISNITTATRCPTQGEPYLKEEQDQQYICRRDVVDRGWGNGCGLFGKGGVVTCAKFSCSEKITGNLVQIENLEYTVVVTVHNGDTHAVGNDTSNHGVTATITPRSPSVEVELPDYGELTLDCEPRSGIDFNEMILMKMKKKTWLVHKQWFLDLPLPWAAGADTSEVHWNYKERMVTFKVPHAKRQDVTVLGSQEGAMHSALAGATEVDSGDGNHMFAGHLKCKVRMEKLRIKGMSYTMCSGKFSIDKEMAETQHGTTVVKVKYEGAGAPCKVPIEIRDVNKEKVVGRVISSIPLAENTNSVTNIELEPPFGDSYIVIGVGNSALTLHWFRKGSSIGKMFESTYRGAKRVAILGETAWDFGSVGGLFTSLGKAVHQVFGSVYTTMFGGVSWMVRILIGLLVLWIGTNSRNTSMAMTCIAVGGITLFLGFTVQADMGCVVSWSGRELKCGSGIFVVDNVHTWTEQYKFQPESPARLASAILNAHKDGVCGIRSTTRLENVMWKQITNELNYVLWEGGHDLTVVAGDVKGVLTKGKRALTPPVSDLKYSWKTWGKAKIFTPEARNSTFLIDGPDTSECPNERRAWNSLEVEDYGFGMFTTNIWMKFREGSSEVCDHRLMSAAIKDQKAVHADMGYWIESSKNQTWQIEKASLIEVKTCLWPKTHTLWSNGVLESQMLIPKSYAGPFSQHNYRQGYATQTVGPWHLGKLEIDFGECPGTTVTIQEDCDHRGPSLRTTTASGKLVTQWCCRSCTMPPLRFLGEDGCWYGMEIRPLSEKEENMVKSQVAAGQGTSETFSMGLLCLTLFVEECLRRRVTRKHMILAVVITLCAIILGGLTWMDLLRALIMLGDTMSGRIGGQTHLAIMAVFKMSPGYVLGVFLRKLTSRETALMVIGMAMTTTLSIPHDLMELIDGISLGLILLKIVTQFDNTQVGTLALSLTFIRSTMSLVMAWRTIMAVLFVVTLIPLCRTSCLQKQSHWVEITALILGAQALPVYLMTLMKGASRRSWPLNEGIMAVGLVSLLGSALLKNDVPLAGPMVAGGLLLAAYVMSGSSADLSLEKAANVQWDEMADITGSSPIIEVKQDEDGSFSIRDVEETNMITLLVKLALITVSGLYPLAIPVTMTLWYMWQVKTQRSGALWDVPSPAATQKAALSEGVYRIMQRGLFGKTQVGVGIHMEGVFHTMWHVTRGSVICHETGRLEPSWADVRNDMISYGGGWRLGDKWDKEEDVQVLAIEPGKNPKHVQTKPGLFKTLTGEIGAVTLDFKPGTSGSPIINRKGKVIGLYGNGVVTKSGDYVSAITQAERIGEPDYEVDEDIFRKKRLTIMDLHPGAGKTKRILPSIVREALKRRLRTLILAPTRVVAAEMEEALRGLPIRYQTPAVKSEHTGREIVDLMCHATFTTRLLSSTRVPNYNLIVMDEAHFTDPSSVAARGYISTRVEMGEAAAIFMTATPPGATDPFPQSNSPIEDIEREIPERSWNTGFDWITDYQGKTVWFVPSIKAGNDIANCLRKSGKKVIQLSRKTFDTEYPKTKLTDWDFVVTTDISEMGANFRAGRVIDPRRCLKPVILTDGPERVILAGPIPVTPASAAQRRGRIGRNPAQEDDQYVFSGDPLKNDEDHAHWTEAKMLLDNIYTPEGIIPTLFGPEREKTQAIDGEFRLRGEQRKTFVELMRRGDLPVWLSYKVASAGISYKDREWCFTGERNNQILEENMEVEIWTREGEKKKLRPRWLDARVYADPMALKDFKEFASGRKSITLDILTEIASLPTYLSSRAKLALDNIVMLHTTERGGRAYQHALNELPESLETLMLVALLGAMTAGIFLFFMQGKGIGKLSMGLITIAVASGLLWVAEIQPQWIAASIILEFFLMVLLIPEPEKQRTPQDNQLIYVILAILTIIGLIAANEMGLIEKTKTDFGFYQVKTETTILDVDLRPASAWTLYAVATTILTPMLRHTIENTSANLSLAAIANQAAVLMGLGKGWPLHRMDLGVPLLAMGCYSQVNPTTLTASLVMLLVHYAIIGPGLQAKATREAQKRTAAGIMKNPTVDGITVIDLEPISYDPKFEKQLGQVMLLVLCAGQLLLMRTTWAFCEVLTLATGPILTLWEGNPGRFWNTTIAVSTANIFRGSYLAGAGLAFSLIKNAQTPRRGTGTTGETLGEKWKRQLNSLDRKEFEEYKRSGILEVDRTEAKSALKDGSKIKHAVSRGSSKIRWIVERGMVKPKGKVVDLGCGRGGWSYYMATLKNVTEVKGYTKGGPGHEEPIPMATYGWNLVKLHSGVDVFYKPTEQVDTLLCDIGESSSNPTIEEGRTLRVLKMVEPWLSSKPEFCIKVLNPYMPTVIEELEKLQRKHGGNLVRCPLSRNSTHEMYWVSGASGNIVSSVNTTSKMLLNRFTTRHRKPTYEKDVDLGAGTRSVSTETEKPDMTIIGRRLQRLQEEHKETWHYDQENPYRTWAYHGSYEAPSTGSASSMVNGVVKLLTKPWDVIPMVTQLAMTDTTPFGQQRVFKEKVDTRTPQPKPGTRMVMTTTANWLWALLGKKKNPRLCTREEFISKVRSNAAIGAVFQEEQGWTSASEAVNDSRFWELVDKERALHQEGKCESCVYNMMGKREKKLGEFGRAKGSRAIWYMWLGARFLEFEALGFLNEDHWFGRENSWSGVEGEGLHRLGYILEEIDKKDGDLMYADDTAGWDTRITEDDLQNEELITEQMAPHHKILAKAIFKLTYQNKVVKVLRPTPRGAVMDIISRKDQRGSGQVGTYGLNTFTNMEVQLIRQMEAEGVITQDDMQNPKGLKERVEKWLRECGVDRLKRMAISGDDCVVKPLDERFGTSLLFLNDMGKVRKDIPQWEPSKGWKNWQEVPFCSHHFHKIFMKDGRSLVVPCRNQDELIGRARISQGAGWSLRETACLGKAYAQMWSLMYFHRRDLRLASMAICSAVPTEWFPTSRTTWSIHAHHQWMTTEDMLKVWNRVWIEDNPNMIDKTPVHSWEDIPYLGKREDLWCGSLIGLSSRATWAKNIHTAITQVRNLIGKEEYVDYMPVMKRYSAPSESEGVL

SEQ ID NO: 5258 - protein, 3288 aa, Artificial Sequence
  derived and/or modified protein sequence (wt) from DENV-4__JQ513336__SS-prME
STITLLCLIPTVMAFHLSTRDGEPLMIVAKHERGRPLLFKTTEGINKCTLIAMDLGEMCEDTVTYKCPLLVNTEPEDIDCWCNLTSTWVMYGTCTQSGERRREKRSVALTPHSGMGLETRAETWMSSEGAWKHAQRVESWILRNPGFALLAGFMAYMIGQTGIQRTVFFVLMMLVAPSYGMRCVGVGNRDFVEGVSGGAWVDLVLEHGGCVTTMAQGKPTLDFELTKTTAKEVALLRTYCIEASISNITTATRCPTQGEPYLKEEQDQQYICRRDVVDRGWGNGCGLFGKGGVVTCAKFSCSEKITGNLVQIENLEYTVVVTVHNGDTHAVGNDTSNHGVTATITPRSPSVEVELPDYGELTLDCEPRSGIDFNEMILMKMKKKTWLVHKQWFLDLPLPWAAGADTSEVHWNYKERMVTFKVPHAKRQDVTVLGSQEGAMHSALAGATEVDSGDGNHMFAGHLKCKVRMEKLRIKGMSYTMCSGKFSIDKEMAETQHGTTVVKVKYEGAGAPCKVPIEIRDVNKEKVVGRVISSIPLAENTNSVTNIELEPPFGDSYIVIGVGNSALTLHWFRKGSSIGKMFESTYRGAKRMAILGETAWDFGSVGGLFTSLGKAVHQVFGSVYTTMFGGVSWMVRILIGLLVLWIGTNSRNTSMAMTCIAVGGITLFLGFTVQADMGCVVSWSGRELKCGSGIFVVDNVHTWTEQYKFQPESPARLASAILNAHKDGVCGIRSTTRLENVMWKQITNELNYVLWEGGHDLTVVAGDVKGVLTKGKRALTPPVSDLKYSWKTWGKAKIFTPEARNSTFLIDGPDTSECPNERRAWNSLEVEDYGFGMFTTNIWMKFREGSSEVCDHRLMSAAIKDQKAVHADMGYWIESSKNQTWQIEKASLIEVKTCLWPKTHTLWSNGVLESQMLIPKSYAGPFSQHNYRQGYATQTVGPWHLGKLEIDFGECPGTTVTIQEDCDHRGPSLRTTTASGKLVTQWCCRSCTMPPLRFLGEDGCWYGMEIRPLSEKEENMVKSQVAAGQGTSETFSMGLLCLTLFVEECLRRRVTRKHMILAVVITLCAIILGGLTWMDLLRALIMLGDTMSGRIGGQTHLAIMAVFKMSPGYVLGVFLRKLTSRETALMVIGMAMTTTLSIPHDLMELIDGISLGLILLKIVTQFDNTQVGTLALSLTFIRSTMSLVMAWRTIMAVLFVVTLIPLCRTSCLQKQSHWVEITALILGAQALPVYLMTLMKGASRRSWPLNEGIMAVGLVSLLGSALLKNDVPLAGPMVAGGLLLAAYVMSGSSADLSLEKAANVQWDEMADITGSSPIIEVKQDEDGSFSIRDVEETNMITLLVKLALITVSGLYPLAIPVTMTLWYMWQVKTQRSGALWDVPSPAATQKAALSEGVYRIMQRGLFGKTQVGVGIHMEGVFHTMWHVTRGSVICHETGRLEPSWADVRNDMISYGGGWRLGDKWDKEEDVQVLAIEPGKNPKHVQTKPGLFKTLTGEIGAVTLDFKPGTSGSPIINRKGKVIGLYGNGVVTKSGDYVSAITQAERIGEPDYEVDEDIFRKKRLTIMDLHPGAGKTKRILPSIVREALKRRLRTLILAPTRVVAAEMEEALRGLPIRYQTPAVKSEHTGREIVDLMCHATFTTRLLSSTRVPNYNLIVMDEAHFTDPSSVAARGYISTRVEMGEAAAIFMTATPPGATDPFPQSNSPIEDIEREIPERSWNTGFDWITDYQGKTVWFVPSIKAGNDIANCLRKSGKKVIQLSRKTFDTEYPKTKLTDWDFVVTTDISEMGANFRAGRVIDPRRCLKPVILTDGPERVILAGPIPVTPASAAQRRGRIGRNPAQEDDQYVFSGDPLKNDEDHAHWTEAKMLLDNIYTPEGIIPTLFGPEREKTQAIDGEFRLRGEQRKTFVELMRRGDLPVWLSYKVASAGISYKDREWCFTGERNNQILEENMEVEIWTREGEKKKLRPRWLDARVYADPMALKDFKEFASGRKSITLDILTEIASLPTYLSSRAKLALDNIVMLHTTERGGRAYQHALNELPESLETLMLVALLGAMTAGIFLFFMQGKGIGKLSMGLITIAVASGLLWVAEIQPQWIAASIILEFFLMVLLIPEPEKQRTPQDNQLIYVILAILTIIGLIAANEMGLIEKTKTDFGFYQVKTETTILDVDLRPASAWTLYAVATTILTPMLRHTIENTSANLSLAAIANQAAVLMGLGKGWPLHRMDLGVPLLAMGCYSQVNPTTLTASLVMLLVHYAIIGPGLQAKATREAQKRTAAGIMKNPTVDGITVIDLEPISYDPKFEKQLGQVMLLVLCAGQLLLMRTTWAFCEVLTLATGPILTLWEGNPGRFWNTTIAVSTANIFRGSYLAGAGLAFSLIKNAQTPRRGTGTTGETLGEKWKRQLNSLDRKEFEEYKRSGILEVDRTEAKSALKDGSKIKHAVSRGSSKIRWIVERGMVKPKGKVVDLGCGRGGWSYYMATLKNVTEVKGYTKGGPGHEEPIPMATYGWNLVKLHSGVDVFYKPTEQVDTLLCDIGESSSNPTIEEGRTLRVLKMVEPWLSSKPEFCIKVLNPYMPTVIEELEKLQRKHGGNLVRCPLSRNSTHEMYWVSGASGNIVSSVNTTSKMLLNRFTTRHRKPTYEKDVDLGAGTRSVSTETEKPDMTIIGRRLQRLQEEHKETWHYDQENPYRTWAYHGSYEAPSTGSASSMVNGVVKLLTKPWDVIPMVTQLAMTDTTPFGQQRVFKEKVDTRTPQPKPGTRMVMTTTANWLWALLGKKKNPRLCTREEFISKVRSNAAIGAVFQEEQGWTSASEAVNDSRFWELVDKERALHQEGKCESCVYNMMGKREKKLGEFGRAKGSRAIWYMWLGARFLEFEALGFLNEDHWFGRENSWSGVEGEGLHRLGYILEEIDKKDGDLMYADDTAGWDTRITEDDLQNEELITEQMAPHHKILAKAIFKLTYQNKVVKVLRPTPRGAVMDIISRKDQRGSGQVGTYGLNTFTNMEVQLIRQMEAEGVITQDDMQNPKGLKERVEKWLRECGVDRLKRMAISGDDCVVKPLDERFGTSLLFLNDMGKVRKDIPQWEPSKGWKNWQEVPFCSHHFHKIFMKDGRSLVVPCRNQDELIGRARISQGAGWSLRETACLGKAYAQMWSLMYFHRRDLRLASMAICSAVPTEWFPTSRTTWSIHAHHQWMTTEDMLKVWNRVWIEDNPNMIDKTPVHSWEDIPYLGKREDLWCGSLIGLSSRATWAKNIHTAITQVRNLIGKEEYVDYMPVMKRYSAPSESEGVL

SEQ ID NO: 5259 - protein, 3288 aa, Artificial Sequence
  derived and/or modified protein sequence (wt) from DENV-4__JQ513338__SS-prME
STITLLCLIPTVMAFHLSTRDGEPLMIVAKHERGRPLLFKTTEGINKCTLIAMDLGEMCEDTVTYKCPLLVNTEPEDIDCWCNLTSTWVMYGTCTQSGERRREKRSVALTPHSGMGLETRAETWMSSEGAWKHAQRVESWILRNPGFALLAGFMAYMIGQTGIQRTVFFVLMMLVAPSYGMRCVGVGNRDFVEGVSGGAWVDLVLEHGGCVTTMAQGKPTLDFELTKTTAKEVALLRTYCIEALISNITTATRCPTQGEPYLKEEQEQQYICRRDVVDRGWGNGCGLFGKGGVVTCAKFSCSGKITGNLVQIENLEYTVVVTVHNGNTPAVGNDTSNHGVTAPITPRSPSVEVKLPDYGELTLDCEPRSGIDFNEMILMKMKKKTWLVHKQWFLDLPLPWTTGADTSEVHWNYKERMVTFKVPHAKRQDVTVLGSQEGAMHSALAGATEVDSGDENHMFAGHLKCKVRMGKLRIKGMSYTMCSGKFSIDKEMAETQHGTTVVKVKYEGAGAPCKVPIEIRDVNKEKVVGRVISATPLAENTNSVTNIELEPPFGDRYIVIGVGNSALTLHWFRKGSSIGKMFESTYRGAKRMAILGETAWDFGSVGGLFTSLGKAVHQVFGSVYTTMFGGVSWMIRILIGFLVLWIGTNSRNTSMAMTCIAVGGITLFLGFTVQADMGCVVSWSGRELKCGSGIFVVDNVHTWTEQYKFQPESPARLASAILNAHKDGVCGIRSTTRLENVMWKQITNELNYVLWEGGHDLTVVAGDVKGVLTKGKRALTPPASDLKYSWKTWGKAKIFTPEARNSTFLIDGPDTSECPNERRAWNSFEVEDYGFGMFTTNIWMKFREGSSEVCDHRLMSAAIKDQKAVHADMGYWIESSKNQTWQIERASLIEVKTCLWPKTHTLWSNGVLESQMLIPKSYAGPFSQHNYRQGYATQTVGPWHLGKLEIDFGECPGTTVTIQENCDHRGPSLRTTTASGKLVTQWCCRSCTMPPLRFLGEDGCWYGMEIRPLSEKEENMVKSQVTAGQGTSETFSMGLLCLTLFVEECLRRRVTRKHMILAVVITLCAIILGGLTWMDLLRALIMLGDTMSGRIGGQTHLAIMAVFKMSPGYVLGVFLRKLTSRETALMVIGMAMTTTLSIPHDLMELIDGISLGLILLKIVTQFDNTQVGTLALSLTFIRSTMSLVMAWRTIMAVLFVVTLIPLCRTSCLQKQSHWVEITALILGAQALPVYLMTLMKGASRRSWPLNEGIMAVGLVSLLGSALLKNDVPLAGPMVAGGLLLAAYVMSGSSADLSLEKAANVQWDEMADITGSSPIIEVKQDEDGSFSIRDVEETNMITLLVKLALITVSGLYPLAIPITMTLWYMWQVKTQRSGALWDVPSPAATQKAALSEGVYRIMQRGLFGKTQVGVGIHMEGVFHTMWHVTRGSVICHETGRLEPSWADVRNDMISYGGGWRLGDKWDKEEDVQVLAIEPGKNPKHVQTKPGLFKTLTGEIGAVTLDFKPGTSGSPIINRKGKVIGLYGNGVVTKSGDYVSAITQAERIGEPDYEVDEDIFRKKRLTIMDLHPGAGKTKRILPSIVREALKRRLRTLILAPTRVVAAEMEEALRGLPIRYQTPAVKSEHTGREIVDLMCHATFTTRLLSSTRVPNYNLIVMDEAHFTDPSSVAARGYISTRVEMGEAAAIFMTATPPGATDPFPQSNSPIEDIEREIPERSWNTGFDWITDYQGKTVWFVPSIKAGNDIANCLRKSGKKVIQLSRKTFDTEYPKTKLTDWDFVVTTDISEMGANFRAGRVIDPRRCLKPVILTDGPERVILAGPIPVTPASAAQRRGRIGRNPAQEDDQYVFSGDPLKNDEDHAHWTEAKMLLDNIYTPEGIIPTLFGPEREKTQAIDGEFRLRGEQRKTFVELMRRGDLPVWLSYKVASAGISYKDREWCFTGERNNQILEENMEVEIWTREGEKKKLRPKWLDARVYADPMALKDFKEFASGRKSITLDILTEIASLPTYLSSRAKLALDNIVMLHTTERGGRAYQHALNELPESLETLMLVALLGAMTAGIFLFFMQGKGIGKLSMGLITIAVASGLLWVAEIQPQWIAASIILEFFLMVLLIPEPEKQRTPQDNQLIYVILTILTIIGLIAANEMGLIEKTKTDFGFYQVKTETTILDVDLRPASAWTLYAVATTILTPMLRHTIENTSANLSLAAIANQAAVLMGLGKGWPLHRMDLGVPLLAMGCYSQVNPTTLTASLVMLLVHYAIIGPGLQAKATREAQKRTAAGIMKNPTVDGITVIDLEPISYDPKFEKQLGQVMLLVLCAGQLLLMRTTWAFCEVLTLATGPILTLWEGNPGRFWNTTIAVSTANIFRGSYLAGAGLAFSLIKNAQTPRRGTGTTGETLGEKWKRQLNSLDRKEFEEYKRSGILEVDRTEAKSALKDGSKIKHAVSRGSSKIRWIVERGMVKPKGKVIDLGCGRGGWSYYMATLKNVTEVKGYTKGGPGHEEPIPMATYGWNLVKLHSGVDVFYKPTEQVDTLLCDIGESSSNPTIEEGRTLRVLKMVEPWLSSKPEFCIKVLNPYMPTVIEELEKLQRKHGGNLVRCPLSRNSTHEMYWVSGASGNIVSSVNTTSKMLLNRFTTRHRKPTYEKDVDLGAGTRSVSTETEKPDMTIIGRRLQRLQEEHKETWHYDQENPYRTWAYHGSYEAPSTGSASSMVNGVVKLLTKPWDVIPMVTQLAMTDTTPFGQQRVFKEKVDTRTPQPKPGTRMVMTTTANWLWALLGKKKNPRLCTREEFISKVRSNAAIGAVFQEEQGWTSASEAVNDSRFWELVDKERALHQEGKCESCVYNMMGKREKKLGEFGRAKGSRAIWYMWLGARFLEFEALGFLNEDHWFGRENSWSGVEGEGLHRLGYILEEIDKKDGDLMYADDTAGWDTRITEDDLQNEELITEQMAPHHKILAKAIFKLTYQNKVVKVLRPTPRGAVMDIISRKDQRGSGQVGTYGLNTFTNMEVQLIRQMEAEGVITQDDMQNPKGLKERVEKWLRECGVDRLKRMAISGDDCVVKPLDERFGTSLLFLNDMGKVRKDIPQWEPSKGWKNWQEVPFCSHHFHKIFMKDGRSLVVPCRNQDELIGRARISQGAGWSLRETACLGKAYAQMWSLMYFHRRDLRLASMAICSAVPTEWFPTSRTTWSIHAHHQWMTTEDMLKVWNRVWIEDNPNMIDKTPVHSWEDIPYLGKREDLWCGSLIGLSSRATWAKNIHTAITQVRNLIGKEEYVDYMPVMKRYSAPSESEGVL

SEQ ID NO: 5260 - protein, 3288 aa, Artificial Sequence
  derived and/or modified protein sequence (wt) from DENV-4__JQ513339__SS-prME
STITLLCLIPTVMAFHLSTRDGEPLMIVAKHERGRPLLFKTTEGINKCTLIAMDLGEMCEDTVTYKCPLLVNTEPEDIDCWCNLTSTWVMYGTCTQSGERRREKRSVALTPHSGMGLETRAETWMSSEGAWKHAQRVESWILRNPGFALLAGFMAYMIGQTGIQRTVFFVLMMLVAPSYGMRCVGVGNRDFVEGVSGGAWVDLVLEHGGCVTTMAQGKPTLDFELTKTTAKEVALLRTYCIEALISNITTATRCPTQGEPYLKEEQDQQYICRRDVVDRGWGNGCGLFGKGGVVTCAKFSCSGKITGNLVQIENLEYTVVVTVHNGDTHAVGNDTSNHGVTATITPRSPSVEVKLPDYGELTLDCEPRSGIDFNEMILMKMKKKTWLVHKQWFLDLPLPWTTGADTSEVHWNYKERMATFKVPHAKRQDVTLLGSQEGAMHSALAGATEVDSGDENHMFAGHLKCKVRMGKLRIKGMSYTMCSGKFSIDKEMAETQHGTTVVKVKYEGAGAPCKVPIEIRDVNKEKVVGRVLSATPLAENTNSVTNIELEPPFGDSYIVIGVGNSALTLHWFTKGSSIGKMFESTYRGAKRMAILGETAWDFGSVGGLFTSLGKAVHQVFGSVYTTMFGGVSWMIRILIGFLVLWIGTNSRNTSMAMTCIAVGGITLFLGFTVQADMGCVVSWSGRELKCGSGIFVVDNVHTWTEQYKFQPESPARLASAILNAHKDGVCGIRSTTRLENVMWKQITNELNYVLWEGGHDLTVVAGDVKGVLTKGKRALTPPASDLKYSWKTWGKAKIFTPEARNSTFLIDGPDTSECPNERRAWNSFEVEDYGFGMFTTNIWMKFREGSSEVCDHRLMSAAIKDQKAVHADMGYWIESSKNQTWQIERASLIEVKTCLWPKTHTLWSNGVLESQMLIPKSYAGPFSQHNYRQGYATQTVGPWHLGKLEIDFGECPGTTVTIQENCDHRGPSLRTTTASGKLVTQWCCRSCTMPPLRFLGEDGCWYGMEIRPLSEKEENMVKSQVTAGQGTSETFSMGLLCLTLFVEECLRRRVTRKHMILAVVITLCAIILGGLTWMDLLRALIMLGDTMSGRIGGQTHLAIMAVFKMSPGYVLGVFLRKLTSRETALMVIGMAMTTTLSIPHDLMELIDGISLGLILLKIVTQFDNTQVGTLALSLTFIRSTMSLVMAWRTIMAVLFVVTLIPLCRTSCLQKQSHWVEITALILGAQALPVYLMTLMKGASRRSWPLNEGIMAVGLVSLLGSALLKNDVPLAGPMVAGGLLLAAYVMSGSSADLSLEKAANVQWDEMADITGSSPIIEVKQDEDGSFSIRDVEETNMITLLVKLALITVSGLYPLAIPITMTLWYMWQVKTQRSGALWDVPSPAATQKAALSEGVYRIMQRGLFGKTQVGVGIHMEGVFHTMWHVTRGSVICHETGRLEPSWADVRNDMISYGGGWRLGDKWDKEEDVQVLAIEPGKNPKHVQTKPGLFKTLTGEIGAVTLDFKPGTSGSPIINRKGKVIGLYGNGVVTKSGDYVSAITQAERIGEPDYEVDEDIFRKKRLTIMDLHPGAGKTKRILPSIVREALKRRLRTLILAPTRVVAAEMEEALRGLPIRYQTPAVKSEHTGREIVDLMCHATFTTRLLSSTRVPNYNLIVMDEAHFTDPSSVAARGYISTRVEMGEAAAIFMTATPPGATDPFPQSNSPIEDIEREIPERSWNTGFDWITDYQGKTVWFVPSIKAGNDIANCLRKSGKKVIQLSRKTFDTEYPKTKLTDWDFVVTTDISEMGANFRAGRVIDPRRCLKPVILTDGPERVILAGPIPVTPASAAQRRGRIGRNPAQEDDQYVFSGDPLKNDEDHAHWTEAKMLLDNIYTPEGIIPTLFGPEREKTQAIDGEFRLRGEQRKTFVELMRRGDLPVWLSYKVASAGISYKDREWCFTGERNNQILEENMEVEIWTREGEKKKLRPKWLDARVYADPMALKDFKEFASGRKSITLDILTEIASLPTYLSSRAKLALDNIVMLHTTERGGRAYQHALNELPESLETLMLVALLGAMTAGIFLFFMQGKGIGKLSMGLITIAVASGLLWVAEIQPQWIAASIILEFFLMVLLIPEPEKQRTPQDNQLIYVILTILTIIGLIAANEMGLIEKTKTDFGFYQVKTETTILDVDLRPASAWTLYAVATTILTPMLRHTIENTSANLSLAAIANQAAVLMGLGKGWPLHRMDLGVPLLAMGCYSQVNPTTLTASLVMLLVHYAIIGPGLQAKATREAQKRTAAGIMKNPTVDGITVIDLEPISYDPKFEKQLGQVMLLVLCAGQLLLMRTTWAFCEVLTLATGPILTLWEGNPGRFWNTTIAVSTANIFRGSYLAGAGLAFSLIKNAQTPRRGTGTTGETLGEKWKRQLNSLDRKEFEEYKRSGILEVDRTEAKSALKDGSKIKHAVSRGSSKIRWIVERGMVKPKGKVIDLGCGRGGWSYYMATLKNVTEVKGYTKGGPGHEEPIPMATYGWNLVKLHSGVDVFYKPTEQVDTLLCDIGESSSNPTIEEGRTLRVLKMVEPWLSSKPEFCIKVLNPYMPTVIEELEKLQRKHGGNLVRCPLSRNSTHEMYWVSGASGNIVSSVNTTSKMLLNRFTTRHRKPTYEKDVDLGAGTRSVSTETEKPDMTIIGRRLQRLQEEHKETWHYDQENPYRTWAYHGSYEAPSTGSASSMVNGVVKLLTKPWDVIPMVTQLAMTDTTPFGQQRVFKEKVDTRTPQPKPGTRMVMTTTANWLWALLGKKKNPRLCTREEFISKVRSNAAIGAVFQEEQGWTSASEAVNDSRFWELVDKERALHQEGKCESCVYNMMGKREKKLGEFGRAKGSRAIWYMWLGARFLEFEALGFLNEDHWFGRENSWSGVEGEGLHRLGYILEEIDKKDGDLMYADDTAGWDTRITEDDLQNEELITEQMAPHHKILAKAIFKLTYQNKVVKVLRPTPRGAVMDIISRKDQRGSGQVGTYGLNTFTNMEVQLIRQMEAEGVITQDDMQNPKGLKERVEKWLRECGVDRLKRMAISGDDCVVKPLDERFGTSLLFLNDMGKVRKDIPQWEPSKGWKNWQEVPFCSHHFHKIFMKDGRSLVVPCRNQDELIGRARISQGAGWSLRETACLGKAYAQMWSLMYFHRRDLRLASMAICSAVPTEWFPTSRTTWSIHAHHQWMTTEDMLKVWNRVWIEDNPNMIDKTPVHSWEDIPYLGKREDLWCGSLIGLSSRATWAKNIHTAITQVRNLIGKEEYVDYMPVMKRYSAPSESEGVL

SEQ ID NO: 5261 - protein, 3288 aa, Artificial Sequence
  derived and/or modified protein sequence (wt) from DENV-4__JQ513343__SS-prME
STITLLCLIPTVMAFHLSTRDGEPLMIVAKHERGRPLLFKTTEGINKCTLIAMDLGEMCEDTVTYKCPLLVNTEPEDIDCWCNLTSTWVMYGTCTQSGERRREKRSVALTPHSGMGLETRAETWMSSEGAWKHAQRVESWILRNPGFALLAGFMAYMIGQTGIQRTVFFVLMMLVAPSYGMRCVGVGNRDFVEGVSGGAWVDLVLEHGGCVTTMAQGKPTLDFELTKTTAKEVALLRTYCIEALISNITTATRCPTQGEPYLKEEQDQQYICRRDVVDRGWGNGCGLFGKGGVVTCAKFSCSGKITGNLVQIENLEYTVVVTVHNGDTHAVGNDTSNHGVTATITPRSPSVEVKLPDYGELTLDCEPRSGIDFNEMILMKMKKKTWLVHKQWFLDLPLPWTTGADTSEVHWNYKERMETFKVPHAKRQDVTLLGSQEGAMHSALAGATEVDSGDENHMFAGHLKCKVRMEKLRIKGMSYTMCSGKFSIDKEMAETQHGTTVVKVKYEGAGAPCKVPIEIRDVNKEKVVGRVISATPLAENTNSVTNIELEPPFGDSYIVIGVGNSALTLHWFRKGSSIGKMFESTYRGAKRMAILGETAWDFGSVGGLFTSLGKAVHQVFGSVYTTMFGGVSWMIRILIGFLVLWIGTNSRNTSMAMTCIAVGGITLFLGFTVQADMGCVVSWSGRELKCGSGIFVVDNVHTWTEQYKFQPESPARLASAILNAHKDGVCGIRSTTRLENVMWKQITNELNYVLWEGGHDLTVVAGDVKGVLTKGKRALTPPASDLKYSWKTWGKAKIFTPEARNSTFLIDGPDTSECPNERRAWNSFEVEDYGFGMFTTNIWMKFREGSSEVCDHRLMSAAIKDQKAVHADMGYWIESSKNQTWQIERASLIEVKTCLWPKTHTLWSNGVLESQMLIPKSYAGPFSQHNYRQGYATQTVGPWHLGKLEIDFGECPGTTVTIQENCDHRGPSLRTTTASGKLVTQWCCRSCTMPPLRFLGEDGCWYGMEIRPLSEKEENMVKSQVTAGQGTSETFSMGLLCLTLFVEECLRRRVTRKHMILAVVITLCAIILGGLTWMDLLRALIMLGDTMSGRIGGQTHLAIMAVFKMSPGYVLGVFLRKLTSRETALMVIGMAMTTTLSIPHDLMELIDGISLGLILLKIVTQFDNTQVGTLALSLTFIRSTMSLVMAWRTIMAVLFVVTLIPLCRTSCLQKQSHWVEITALILGAQALPVYLMTLMKGASRRSWPLNEGIMAVGLVSLLGSALLKNDVPLAGPMVAGGLLLAAYVMSGSSADLSLEKAANVQWDEMADITGSSPIIEVKQDEDGSFSIRDVEETNMITLLVKLALITVSGLYPLAIPITMTLWYMWQVKTQRSGALWDVPSPAATQKAALSEGVYRIMQRGLFGKTQVGVGIHMEGVFHTMWHVTRGSVICHETGRLEPSWADVRNDMISYGGGWRLGDKWDKEEDVQVLAIEPGKNPKHVQTKPGLFKTLTGEIGAVTLDFKPGTSGSPIINRKGKVIGLYGNGVVTKSGDYVSAITQAERIGEPDYEVDEDIFRKKRLTIMDLHPGAGKTKRILPSIVREALKRRLRTLILAPTRVVAAEMEEALRGLPIRYQTPAVKSEHTGREIVDLMCHATFTTRLLSSTRVPNYNLIVMDEAHFTDPSSVAARGYISTRVEMGEAAAIFMTATPPGATDPFPQSNSPIEDIEREIPERSWNTGFDWITDYQGKTVWFVPSIKAGNDIANCLRKSGKKVIQLSRKTFDTEYPKTKLTDWDFVVTTDISEMGANFRAGRVIDPRRCLKPVILTDGPERVILAGPIPVTPASAAQRRGRIGRNPAQEDDQYVFSGDPLKNDEDHAHWTEAKMLLDNIYTPEGIIPTLFGPEREKTQAIDGEFRLRGEQRKTFVELMRRGDLPVWLSYKVASAGISYKDREWCFTGERNNQILEENMEVEIWTREGEKKKLRPKWLDARVYADPMALKDFKEFASGRKSITLDILTEIASLPTYLSSRAKLALDNIVMLHTTERGGRAYQHALNELPESLETLMLVALLGAMTAGIFLFFMQGKGIGKLSMGLITIAVASGLLWVAEIQPQWIAASIILEFFLMVLLIPEPEKQRTPQDNQLIYVILTILTIIGLIAANEMGLIEKTKTDFGFYQVKTETTILDVDLRPASAWTLYAVATTILTPMLRHTIENTSANLSLAAIANQAAVLMGLGKGWPLHRMDLGVPLLAMGCYSQVNPTTLTASLVMLLVHYAIIGPGLQAKATREAQKRTAAGIMKNPTVDGITVIDLEPISYDPKFEKQLGQVMLLVLCAGQLLLMRTTWAFCEVLTLATGPILTLWEGNPGRFWNTTIAVSTANIFRGSYLAGAGLAFSLIKNAQTPRRGTGTTGETLGEKWKRQLNSLDRKEFEEYKRSGILEVDRTEAKSALKDGSKIKHAVSRGSSKIRWIVERGMVKPKGKVIDLGCGRGGWSYYMATLKNVTEVKGYTKGGPGHEEPIPMATYGWNLVKLHSGVDVFYKPTEQVDTLLCDIGESSSNPTIEEGRTLRVLKMVEPWLSSKPEFCIKVLNPYMPTVIEELEKLQRKHGGNLVRCPLSRNSTHEMYWVSGASGNIVSSVNTTSKMLLNRFTTRHRKPTYEKDVDLGAGTRSVSTETEKPDMTIIGRRLQRLQEEHKETWHYDQENPYRTWAYHGSYEAPSTGSASSMVNGVVKLLTKPWDVIPMVTQLAMTDTTPFGQQRVFKEKVDTRTPQPKPGTRMVMTTTANWLWALLGKKKNPRLCTREEFISKVRSNAAIGAVFQEEQGWTSASEAVNDSRFWELVDKERALHQEGKCESCVYNMMGKREKKLGEFGRAKGSRAIWYMWLGARFLEFEALGFLNEDHWFGRENSWSGVEGEGLHRLGYILEEIDKKDGDLMYADDTAGWDTRITEDDLQNEELITEQMAPHHKILAKAIFKLTYQNKVVKVLRPTPRGAVMDIISRKDQRGSGQVGTYGLNTFTNMEVQLIRQMEAEGVITQDDMQNPKGLKERVEKWLRECGVDRLKRMAISGDDCVVKPLDERFGTSLLFLNDMGKVRKDIPQWEPSKGWKNWQEVPFCSHHFHKIFMKDGRSLVVPCRNQDELIGRARISQGAGWSLRETACLGKAYAQMWSLMYFHRRDLRLASMAICSAVPTEWFPTSRTTWSIHAHHQWMTTEDMLKVWNRVWIEDNPNMIDKTPVHSWEDIPYLGKREDLWCGSLIGLSSRATWAKNIHTAITQVRNLIGKEEYVDYMPVMKRYSAPSESEGVL

SEQ ID NO: 5262 - protein, 3288 aa, Artificial Sequence
  derived and/or modified protein sequence (wt) from DENV-4__KT276273__SS-prME
STITLLCLIPTVMAFHLSTRDGEPLMIVAKHERGRPLLFKTTEGINKCTLIAMDLGEMCEDTVTYKCPLLVNTEPEDIDCWCNLTSTWVMYGTCTQSGERRREKRSVALTPHSGMGLETRAETWMSSEGAWKHAQRVESWILRNPGFALLAGFMAYMIGQTGIQRTVFFVLMMLVAPSYGMRCVGVGNRDFVEGVSGGAWVDLVLEHGGCVTTMAQGRPTLDFELTKTTAKEVALLRTYCIEASISNITTATRCPTQGEPYLKEEQDQQYICRRDVVDRGWGNGCGLFGKGGVVTCAKFSCSGKITGNLVQIENLEYTVVVTVHNGDTHAVGNDTSNHGVTATITPRSPSVEVELPDYGELTLDCEPRSGIDFNEMILMKMNKKTWLVHKQWFLDLPLPWTAGADTSEVHWNNKERMVTFKVPHAKRQDVTVLGSQEGAMHSALAGATEVDSGDGNHMFAGHLKCKVRMEKLRIKGMSYTMCSGKFSIDKEMAETQHGTTVVKVKYEGAGAPCKVPIEIRDVNKEKVIGRVISSIPLAENTNSVTNIELEPPFGDSYIVIGVGNSALTLHWFRKGSSIGKMFESTYRGAKRMAILGETAWDFGSVGGLFTSLGKAVHQVFGSVYTTMFGGVSWMIRILIGFLVLWIGTNSRNTSMAMTCIAVGGITLFLGFTVQADMGCVVSWSGRELKCGSGIFVIDNVHTWTEQYKFQPESPARLASAILNAHKDGVCGIRSTTRLENVMWKQITNELNYVLWEGGHDLTVVAGDVKGVLTKGKRALTPPASDLKYSWKTWGKAKIFTPEARNSTFLIDGPDTSECPNERRAWNSLEVEDYGFGMFTTNIWMKFREGSSEMCDHRLMSAAIKDQKAVHADMGYWIESSKNQTWQIEKASLIEVKTCLWPKTHTLWSNGVLESQMLIPKSYAGPFSQHNYRQGYATQIAGPWHLGKLEIDFGECPGTTVTIQEDCDHRGPSLRTTTASGKLVTQWCCRSCTMPPLRFLGEDGCWYGMEIRPLSEKEENMVKSQVAAGQGTSETFSMGLLCLTLFVEECLRRRVTRKHMILVVVITFCAIILGGLTWMDLLRALIMLGDTMSGRIGGQIHLAIMAVFKMSPGYVLGVFLRKLTSRETALMVIGMAMTTVLSIPYDLMELIDGISLGLILLKIVTQFDNTQVGTLALSLTFIRSTMPLVMAWRTIMAVLFVVTLIPLCRTSCLQKQSHWVEITALILGAQALPVYLMTLMKGASRRSWPLNEGIMAVGLVSLLGSALLKNDVPLAGPMVAGGLLLAAYVMSGSSADLSLEKAANVQWDEMADITGSSPIIEVKQDEDGSFSIRDVEETNMITLLVKLALITVSGLYPLAIPVTMTLWYMWQVKTQRSGALWDVPSPAATQKAALSEGVYRIMQRGLFGKTQVGVGIHMEGVFHTMWHVTRGSVICHETGRLEPSWADVRNDMISYGGGWRLGDKWDKEEDVQVLAIEPGKNPKHVQTKPGLFKTLTGEIGAVTLDFKPGTSGSPIINRKGKVIGLYGNGVVTKSGDYVSAITQAERIGEPDYEVDEDIFRKKRLTIMDLHPGAGKTKRILPSIVREALKRRLRTLILAPTRVVAAEMEEALRGLPIRYQTPAVKSEHTGREIVDLMCHATFTTRLLSSTRVPNYNLIVMDEAHFTDPSSVAARGYISTRVEMGEAAAIFMTATPPGATDPFPQSNSPIEDIEREIPERSWNTGFDWITDYQGKTVWFVPSIKAGNDIANCLRKSGKKVIQLSRKTFDTEYPKTKLTDWDFVVTTDISEMGANFRAGRVIDPRRCLKPVILTDGPERVILAGPIPVTPASAAQRRGRIGRNPAQEDDQYVFSGDPLKNDEDHAHWTEAKMLLDNIYTPEGIIPTLFGPEREKTQAIDGEFRLRGEQRKTFVELMRRGDLPVWLSYKVASAGISYKDREWCFTGERNNQILEENMEVEIWTREGEKKKLRPRWLDARVYADPMALKDFKEFASGRKSITLDILTEIASLPTYLSSRAKLALDNIVMLHTTERGGRAYQHALNELPESLETLMLVALLGAMTAGIFLFFMQGKGIGKLSMGLITIAVASGLLWVAEIQPQWIAASIILEFFLMVLLIPEPEKQRTPQDNQLIYVILTILTIIGLIAANEMGLIEKTKTDFGFYQVKTETTILDVDLRPASAWTLYAVATTILTPMLRHTIENTSANLSLAAIANQAAVLMGLGKGWPLHRMDLGVPLLAMGCYSQVNPTTLTASLVMLLVHYAIIGPGLQAKATREAQKRTAAGIMKNPTVDGITVIDLEPISYDPKFEKQLGQVMLLVLCAGQLLLMRTTWAFCEVLTLATGPILTLWEGNPGRFWNTTIAVSTANIFRGSYLAGAGLAFSLIKNAQTPRRGTGTTGETLGEKWKRQLNSLDRKEFEEYKRSGILEVDRTEAKSALKDGSKIKHAVSRGSSKIRWIVERGMVKPKGKVVDLGCGRGGWSYYMATLKNVTEVKGYTKGGPGHEEPIPMATYGWNLVKLHSGVDVFYKPTEQVDTLLCDIGESSSNPTIEEGRTLRVLKMVEPWLSSKPEFCIKVLNPYMPTVIEELEKLQRKHGGNLVRCPLSRNSTHEMYWVSGASGNIVSSVNTTSKMLLNRFTTRHRKPTYEKDVDLGAGTRSVSTETEKPDMTIIGRRLQRLQEEHKETWHYDQENPYRTWAYHGSYEAPSTGSASSMVNGVVKLLTKPWDVIPMVTQLAMTDTTPFGQQRVFKEKVDTRTPQPKPGTRMVMTTTANWLWALLGKKKNPRLCTKEEFISKVRANAAIGAVFQEEQGWTSASEAVNDSRFWELVDKERALHQEGKCESCVYNMMGKREKKLGEFGRAKGSRAIWYMWLGARFLEFEALGFLNEDHWFGRENSWSGVEGEGLHRLGYILEEIDKKDGDLMYADDTAGWDTRITEDDLQNEELITEQMAPHHKILAKAIFKLTYQNKVVKVLRPTPRGAVMDIISRKDQRGSGQVGTYGLNTFTNMEVQLIRQMEAEGVITQDDMQNPKGLKERVEKWLRECGVDRLKRMAISGDDCVVKPLDERFATSLLFLNDMGKVRKDIPQWEPSKGWKNWQEVPFCSHHFHKIFMKDGRSLVVPCRNQDELIGRARISQGAGWSLKETACLAKAYAQMWSLMYFHRRDLRLASMAICSAVPTEWFPTSRTTWSIHAHHQWMTTEDMLKVWNRVWIEDNPNMIDKTPVHSWEDIPYLGKREDLWCGSLIGLSSRATWAKNIHTAITQVRNLIGKEEYMDYMPVMRRYSAPSESEGVL

SEQ ID NO: 5263 - protein, 3288 aa, Artificial Sequence
  derived and/or modified protein sequence (wt) from DENV-4__KU523872__SS-prME
STMTLLCLIPTVMAFHLSTRDGEPLMIVAKHERGRPLLFKTTEGINKCTLIAMDLGEMCEDTVTYKCPLLVNTEPEDIDCWCNLTSTWVMYGTCTQSGERRREKRSVALTPHSGMGLETRAETWMSSEGAWKHAQRVESWILRNPGFALLAGFMAHMIGQTGIQRTVFFVLMMLVAPSYGMRCVGVGNRDFVEGVSGGAWVDLVLEHGGCVTTMAQGKPTLDFELTKTTAKEVALLRTYCIEASISNITTATRCPTQGEPYLKEEQDQQYICRRDVVDRGWGNGCGLFGKGGVVTCAKFSCSGKITGNLVQIENLEYTVVVTVHNGDTHAVGNDTSNHGVTATITPRSPSVEVKLPDYGELTLDCEPRSGIDFNEMILMKMKKKTWLVHKQWFLDLPLPWTAGADTSEVHWNYKERMVTFKVPHAKRQDVTVLGSQEGAMHSALAGATEVDSGDGNHMFAGHLKCKVRMEKLRIKGMSYTMCSGKFSIDKEMAETQHGTTVVKVKYEGAGAPCKVPIEIRDVNKEKVVGRIISSTPFAENTNSVTNIELEPPFGDSYIVIGVGDSALTLHWFRKGSSIGKMFESTYRGAKRMAILGETAWDFGSVGGLFTSLGKAVHQVFGSVYTTMFGGVSWMIRILIGFLVLWIGTNSRNTSMAMTCIAVGGITLFLGFTVQADMGCVVSWNGKELKCGNGIFVVDNVHTWTEQYKFQPESPARLASAILNAHKDGVCGIRSTTRLENVMWKQITNELNYVLWEGGHDLTVVAGDVKGVLTKGKRALTPPVNDLKYSWKTWGKAKIFTPEARNSTFLIDGPDTSECPNERRAWNFFEVEDYGFGMFTTNIWMKFREGSSEVCDHRLMSAAIKDQKAVHADMGYWIESSKNQTWQIEKASLIEVKTCLWPKTHTLWSNGVLESQMLIPRSYAGPFSQHNYRQGYATQTAGPWHLGKLEIDFGECPGTTVTIQEDCDHRGPSLRTTTASGKLVTQWCCRSCTMPPLRFLGEDGCWYGMEIRPLSEKEENMVKSQVTAGQGTSETFSMGLLCLTLFVEECLRRRVTRKHMILVVVITFCAIILGGLTWVDLLRALIMLGDTMSGRIGGQIHLAIMAVFKMSPGYVLGVFLRKLTSRETALMVIGMAMTTVFSIPHDLMELIDGISLGLILLKIVTHFDNTQVGTLALSLTFIRSTTPLVMAWRTIMAVFFVVTLIPLCRTSCLQKQSHWVEITALILGAQALPVYLMTLMKGASRRSWPLNEGIMAVGLVSLLGSALLKNDVPLAGPMVAGGLLLAAYVMSGSSADLSLEKAANVQWDEMADITGSSPVIEVKQDEDGSFSIRDVEETNMITLLVKLALITVSGLYPLAIPVTMAIWYIWQVKTQRSGALWDVPSPAATQKATLSEGVYRIMQRGLFGKTQVGVGIHMEGVFHTMWHVTRGSVICHETGRLEPSWADVRNDMISYGGGWKLGDKWDKEEDVQVLAIEPGKNPKHVQTKPGLFKTLTGEIGAVTLDFKPGTSGSPIINKKGKVIGLYGNGVVTKSGDYVSAITQAERIGEPDYEVDEDIFRKKRLTIMDLHPGAGKTKRILPSIVREALKRRLRTLILAPTRVVAAEMEEALRGLPIRYQTPAVKSEHTGREIVDLMCHATFTTRLLSSTRVPNYNLIVMDEAHFTDPCSVAARGYISTRVEMGEAAAIFMTATPPGSIDPFPQSNSPIEDIEREIPERSWNTGFDWITDYQGKTVWFVPSIKAGNDIANCLRKSGKRVIQLSRKTFDTEYPKTKLTDWDFVVTTDISEMGANFRAGRVIDPRRCLKPVILTDGPERVILAGPIPVTPASAAQRRGRIGRNPAQEDDQYVFSGDPLRNDEDHAHWTEAKMLLDNIYTPEGIIPTLFGPEREKTQAIDGEFRLRGEQRKTFVELMRRGDLPVWLSYKVASAGISYKDREWCFTGERNNQILEENMEVEIWTREGEKKKLRPKWLDARVYADPMALKDFKEFASGRKSITLDILTEIATLPTYLSSKAKLALDNIVMLHTTEKGGRAYQHALNELPESLETLMLVALLGAMTAGIFLFFMQGKGIGKLSMGLIAIAVASGLLWVAEIQPQWIAASIILEFFLMVLLIPEPEKQRTPQDNQLIYVILTILTIIGLVAANEMGLIEKTKTDFGFYQVKTETTILDVDLRPASAWTLYAVATTILTPMLRHTIENTSANLSLAAIANQAAVLMGLGKGWPLHRMDLGVPLLAIGCYSQVNPTTLTASLVMLLVHYAIIGPGLQAKATREAQKRTAAGIMKNPTVDGITVIDLEPISYDPKFEKQLGQVMLLVLCVGQLLLMRTTWALCEVLTLATGPIMTLWEGNPGRFWNTTIAVSTANIFRGSYLAGAGLAFSLIKNAQTPRRGTGTTGETLGEKWKRQLNSLDRKEFEEYKRSGILEVDRTEAKSALRDGSKTKHAVSRGSSKIRWIVERGMIKPKGKVVDLGCGRGGWSYYMATLKNVTEVKGYTKGGPGHEEPIPMATYGWNLVKLHSGVDVFYKPTEQVDTLLCDIGESSSNPTIEEGKTLRVLKMVEPWLSSKPEFCIKVLNPYMPTVIEELEKLQRRHGGSLVRCPLSRNSTHEMYWVSGASGNIVSSVNTISKMLLNRFTTRYRKPTYEKDVDLGAGTRSVSTETEKPDMTIIGRRLQRLREEHKETWHYDQENPYRTWAYHGSYEAPSTGSASSMVNGVVKLLTKPWDVVPMVTQLAMTDTTPFGQQRVFKEKVDTRTPQPKPGTRKIMTTTANWLWALLGKKKSPRLCTREEFISKVRSNAAIGAVFQEEQGWTSASEAVNDSRFWELVDKERALHQEGRCESCVYNMMGKREKKLGEFGRAKGSRAIWYMWLGARFLEFEALGFLNEDHWFSRENSWSGVEGEGLHRLGYILEDIDKKDGDLIYADDTAGWDTRITEDDLLNEELITEQMAPHHKTLAKAIFKLTYQNKVVKVLRPTPKGAVMDIISRKDQRGSGQVGTYGLNTFTNMEVQLIRQMEAEGVITQDDMQNPEGLKERVEKWLKECGVDRLKRMAISGDDCVVKPLDERFSTSLLFLNDMGKVRKDIPQWEPSKGWKNWQEVPFCSHHFHKIFMKDGRSLVVPCRNQDELIGRARISQGAGWSLRETACLGKAYAQMWSLMYFHRRDLRLASMAICSAVPTEWFPTSRTTWSIHAHHQWMTTEDMLKVWNRVWIEDNPNMTDKTPVHSWEDIPYLGKREDLWCGSLIGLSSRATWAKNIHTAITQVRNLIGKEEYVDYMPAMKRYSAPFESEGVL

SEQ ID NO: 5264 - protein, 3288 aa, Artificial Sequence
  derived and/or modified protein sequence (wt) from DENV-4__KP140942__SS-prME
STITLLCLIPTVMAFHLSTRDGEPLMIVAKHERGRPLLFKTTEGINKCTLIAMDLGEMCEDTVTYKCPLLVNTEPEDIDCWCNLTSTWVMYGTCTQSGERRREKRSVALTPHSGMGLETRAETWMSSEGAWKHAQRVESWILRNPGFALLAGFMAYMIGQTGIQRTVFFVLMMLVAPSYGMRCVGVGNRDFVEGVSGGAWVDLVLEHGGCVTTMAQGRPTLDFELTKTTAKEVALLRTYCIEASISNITTATRCPTQGEPYLKEEQDQQYICRRDVVDRGWGNGCGLFGKGGVVTCAKFSCSGKITGNLVQIENLEYTVVVTVHNGDTHAVGNDTSNHGVTATITPRSPSVEVELPDYGELTLDCEPRSGIDFNEMILMKMNKKTWLVHKQWFLDLPLPWTAGADTSEVHWNNKERMVTFKVPHAKRQDVTVLGSQEGAMHSALAGATEVDSGDGNHMFAGHLKCKVRMEKLRIKGMSYTMCSGKFSIDKEMAETQHGTTVVKVKYEGAGAPCKVPIEIRDVNKEKVIGRVISSIPLAENTNSVTNIELEPPFGDSYIVIGVGNSALTLHWFRKGSSIGKMFESTYRGAKRMAILGETAWDFGSVGGLFTSLGKAVHQVFGSVYTTMFGGVSWMIRILIGFLVLWIGTNSRNTSMAMTCIAVGGITLFLGFTVQADMGCVVSWSGRELKCGSGIFVIDNVHTWTEQYKFQPESPARLASAILNAHKDGVCGIRSTTRLENVMWKQITNELNYVLWEGGHDLTVVAGDVKGVLTKGKRALTPPASDLKYSWKTWGKAKIFTPEARNSTFLIDGPDTSECPNERRAWNSLEVEDYGFGMFTTNIWMKFREGSSEMCDHRLMSAAIKDQKAVHADMGYWIESSKNQTWQIEKASLIEVKTCLWPKTHTLWSNGVLESQMLIPKSYAGPFSQHNYRQGYATQIAGPWHLGKLEIDFGECPGTTVTIQEDCDHRGPSLRTTTASGKLVTQWCCRSCTMPPLRFLGEDGCWYGMEIRPLSEKEENMVKSQVAAGQGTSETFSMGLLCLTLFVEECLRRRVTRKHMILAVVITLCAIILGGLTWMDLLRALIMLGDTMSGRMGGQTHLAIMAVFKMSPGYVLGVFLRKLTSRETALMVIGMAMTTTLSIPHDLMELIDGISLGLILLKIVTQFDNTQVGTLALSLTFIRSTMSLVMAWRTIMAVLFVVTLIPLCRTSCLQKQSHWVEITALILGAQALPVYLMTLMKGASKRSWPLNEGIMAVGLVSLLGSALLKNDVPLAGPMVAGGLLLAAYVMSGSSADLSLEKAANVQWDEMADITGSSPIIEVKQDEDGSFSIRDVEETNMITLLVKLALITVSGLYPLAIPVTMTLWYMWQVKTQRSGALWDVPSPAATQKAALSEGVYRIMQRGLFGKTQVGVGIHMEGVFHTMWHVTRGSVICHETGRLEPSWADVRNDMISYGGGWRLGDKWDKEEDVQVLAIEPGKNPKHVQTKPGLFKTLTGEIGAVTLDFKPGTSGSPIINRKGKVIGLYGNGVVTKSGDYVSAITQAERIGEPDYEVDEDIFRKKRLTIMDLHPGAGKTKRILPSIVREALKRRLRTLILAPTRVVAAEMEEALRGLPIRYQTPAVKSEHTGREIVDLMCHATFTTRLLSSTRVPNYNLIVMDEAHFTDPSSVAARGYISTRVEMGEAAAIFMTATPPGATDPFPQSNSPIEDIEREIPERSWNTGFDWITDYQGKTVWFVPSIKAGNDIANCLRKSGKKVIQLSRKTFDTEYPKTKLTDWDFVVTTDISEMGANFRAGRVIDPRRCLKPVILTDGPERVILAGPIPVTPASAAQRRGRIGRNPAQEDDQYVFSGDPLKNDEDHAHWTEAKMLLDNIYTPEGIIPTLFGPEREKTQAIDGEFRLRGEQRKTFVELMRRGDLPVWLSYKVASAGISYKDREWCFTGERNNQILEENMEVEIWTREGEKKKLRPRWLDARVYADPMALKDFKEFASGRKSLTLDILTEIASLPTYLSSRAKLALDNIVMLHTTERGGRAYQHALNELPESLETLMLVALLGAMTAGIFLFFMQGKGIGKLSMGLITIAVASGLLWVAEIQPQWIAASIILEFFLMVLLIPEPEKQRTPQDNQLIYVILTILTIIGLIAANEMGLIEKTKTDFGFYQVKTETTILDVDLRPASAWTLYAVATTILTPMLRHTIENTSANLSLAAIANQAAVLMGLGKGWPLHRMDLGVPLLAMGCYSQVNPTTLTASLVMLLVHYAIIGPGLQAKATREAQKRTAAGIMKNPTVDGITVIDLEPISYDPKFEKQLGQVMLLVLCAGQLLLMRTTWAFCEVLTLATGPILTLWEGNPGRFWNTTIAVSTANIFRGSYLAGAGLAFSLIKNAQTPRRGTGTTGETLGEKWKRQLNSLDRKEFEEYKRSGILEVDRTEAKSALKDGSKIKHAVSRGSSKIRWIVERGMVKPKGKVVDLGCGRGGWSYYMATLKNVTEVKGYTKGGPGHEEPIPMATYGWNLVKLHSGVDVFYKPTEQVDTLLCDIGESSSNPTIEEGRTLRVLKMVEPWLSSKPEFCIKVLNPYMPTVIEELEKLQRKHGGNLVRCPLSRNSTHEMYWVSGASGNIVSSVNTTSKMLLNRFTTRHRKPTYEKDVDLGAGTRSVSTETEKPDMTIIGRRLQRLQEEHKETWHYDQENPYRTWAYHGSYEAPSTGSASSMVNGVVKLLTKPWDVIPMVTQLAMTDTTPFGQQRVFKEKVDTRTPQPKPGTRMVMTTTANWLWALLGKKKNPRLCTKEEFISKVRANAAIGAVFQEEQGWTSASEAVNDSRFWELVDKERALHQEGKCESCVYNMMGKREKKLGEFGRAKGSRAIWYMWLGARFLEFEALGFLNEDHWFGRENSWSGVEGEGLHRLGYILEEIDKKDGDLMYADDTAGWDTRITEDDLQNEELITEQMAPHHKILAKAIFKLTYQNKVVKVLRPTPRGAVMDIISRKDQRGSGQVGTYGLNTFTNMEVQLIRQMEAEGVITQDDMQNPKGLKERVEKWLRECGVDRLKRMAISGDDCVVKPLDERFATSLLFLNDMGKVRKDIPQWEPSKGWKNWQEVPFCSHHFHKIFMKDGRSLVVPCRNQDELIGRARISQGAGWSLKETACLAKAYAQMWSLMYFHRRDLRLASMAICSAVPTEWFPTSRTTWSIHAHHQWMTTEDMLKVWNRVWIEDNPNMIDKTPVHSWEDIPYLGKREDLWCGSLIGLSSRATWAKNIHTAITQVRNLIGKEEYMDYMPVMRRYSAPSESEGVL

SEQ ID NO: 5265 - protein, 3288 aa, Artificial Sequence
  derived and/or modified protein sequence (wt) from DENV-4__KU523871__SS-prME
STMTLLCLIPTVMAFHLSTRDGEPLMIVAKHERGRPLLFKTTEGINKCTLIAMDLGEMCEDTVTYKCPLLVNTEPEDIDCWCNLTSTWVMYGTCTQNGERRREKRSVALTPHSGMGLETRAETWMSSEGAWKHAQRVESWILRNPGFALLAGFMAYMIGQTGIQRIVFFVLMMLVAPSYGMRCVGVGNRDFVEGVSGGAWVDLVLEHGGCVTTMAQGKPTLDFELTKTTAKEVALLRTYCIEASISNITTATRCPTQGEPYLKEEQDQQYICRRDVVDRGWGNGCGLFGKGGVVTCAKFSCSGKITGNLVQIENLEYTVVVTVHNGDTHAVGNDTSNHGVTATITPRSPSVEVKLPDYGELTLDCEPRSGIDFNEMILMKMKKKTWLVHKQWFLDLPLPWTAGADTSEVHWNHKERMVTFKVPHAKRQDVTVLGSQEGAMHSALAGATEVDSGDGNHMFAGHLKCKVRMEKLRIKGMSYTMCSGKFSIDKEMAETQHGTTVVKVKYEGAGAPCKVPIEIRDVNKEKVVGRIISSTPFAENTNSVTNIELEPPFGDSYIVIGVGESALTLHWFRKGSSIGKMFESTYRGAKRMAILGETAWDFGSVGGLFTSLGKAVHQVFGSVYTTMFGGVSWMVRILIGFLVLWIGTNSRNTSMAMTCIAVGGITLFLGFTVQADMGCVVSWSGKELKCGSGIFVVDNVHTWTEQYKFQPESPARLASAILNAHKDGVCGIRSTTRLENVMWKQITNELNYVLWEGGHDLTVVAGDVKGVLTRGKRALTPPVNDLKYSWKTWGKAKIFTPEARNSTFLIDGPDTSECPNERRAWNFFEVEDYGFGMFTTNIWMKFREGSSEVCDHRLMSAAIKDQKAVHADMGYWIESSKNQTWQIEKASLIEVKTCLWPKTHTLWSNGVLESQMLIPRSYAGPFSQHNYRQGYATQTVGPWHLGKLEIDFGECPGTTVAIREDCDHRGPSLRTTTASGKLVTQWCCRSCTMPPLRFLGEDGCWYGMEIRPLSEKEENMVKSQATAGQGTSETFSMGLLCLTLFVEECLRRRVTRKHMILVVVITFCAIILGGLTWMDLLRALIMLGDTMSGRIGGQIHLAIMAVFKMSPGYVLGVFLRKLTSRETALMVIGMAMTTVFSIPHDLMELIDGISLGLILLKIVTHFDNTQVGTLALSLTFLRSTTPLVMAWRTIMAVFFVVTLIPLCRTSCLQKQSHWVEITALILGAQALPVYLMTLMKGASRRSWPLNEGIMAVGLVSLLGSALLKNDVPLAGPMVAGGLLLAAYVMSGSSADLSLEKAANVQWDEMADITGSSPIIEVKQDEDGSFSIRDVEETNMMTLLVKLALITVSGLYPLAIPVTMALWYIWQVKTQRSGALWDVPSPAATQKATLSEGVYRIMQRGLFGKTQVGVGIHMEGVFHTMWHVTRGSVICHETGRLEPSWADVRNDMISYGGGWRLGDKWDKEEDVQVLAIEPGKNPKHVQTKPGLFKTLTGEIGAVTLDFKPGTSGSPIINKKGKVIGLYGNGVVTKSGDYVSAITQAERIGEPDYEVDEDIFRKKRLTIMDLHPGAGKTKRILPSIVREALKRRLRTLILAPTRVVAAEMEEALRGLPIRYQTPAVKSEHTGREIVDLMCHATFTTRLLSSTRVPNYNLIVMDEAHFTDPCSVAARGYISTRVEMGEAAAIFMTATPPGATDPFPQSNSPIEDIEREIPERSWNTGFDWITDYQGKTVWFVPSIKAGNDIANCLRKSGKRVIQLSRKTFDTEYPKTKLTDWDFVVTTDISEMGANFRAGRVIDPRRCLKPVILTDGPERVILAGPIPVTPASAAQRRGRIGRNPAQEDDQYVFSGDPLKNDEDHAHWTEAKMLLDNIYTPEGIIPTLFGPEREKTQAIDGEFRLRGEQRKTFVELMKRGDLPVWLSYKVASAGISYKDREWCFTGERNNQILEENMEVEIWTKEGEKKKLRPKWLDARVYADPMALKDFKEFASGRKSITLDILTEIASLPTYLSSKAKLALDNIIMLHTTEKGGRAYQHALNELPESLETLMLVALLGAMTAGIFLFFMQGKGIGKLSMGLIAIAVASGLLWVAEIQPQWIAASIILEFFLMVLLIPEPEKQRTPQDNQLIYVILTILTIIGLIAANEMGLIEKTKTDFGFYQVKTETTILDVDLRPASAWTLYAVATTILTPMLRHTIENTSANLSLAAIANQAAVLMGLGKGWPLHRMDLGVPLLAIGCYSQVNPTTLTASLVMLLVHYAIIGPGLQAKATREAQKRTAAGIMKNPTVDGITVIDLEPISYDPKFEKQLGQVMLLVLCAGQLLLMRTTWALCEVLTLATGPAMTLWEGNPGRFWNTTIAVSTANIFRGSYLAGAGLAFSLIKNAQTPRRGTGTTGETLGEKWKRQLNSLDRKEFEEYKRSGILEVDRTEAKSALKDGSKIKHAVSRGSSKIRWIVERGMVKPKGKVVDLGCGRGGWSYYMATLKNVTEVKGYTKGGPGHEEPIPMATYGWNLVKLHSGVDVFYKPTEQVDTLLCDIGESSSNPTIEEGRTLRVLKMVEPWLSSKPEFCIKVLNPYMPTVIEELEKLQRRHGGSLVRCPLSRNSTHEMYWVSGASGNIVSSVNTISKMLLNRFTTRHRKPTYEKDVDLGAGTRSVSTETEKPDMTIIGRRLQRLREEHKETWHYDQENPYRTWAYHGSYEAPSTGSASSMVNGVVKLLTKPWDVVPMVTQLAMTDTTPFGQQRVFKEKVDTRTPQPKPGTRMIMTTTANWLWTLLGKKKSPRLCTREEFISKVRSNAAIGAVFQEEQGWTSASEAVNDSRFWELVDKERALHQEGKCESCVYNMMGKREKKLGEFGRAKGSRAMWYMWLGARFLEFEALGFLNEDHWFSRENSWSGVEGEGLHRLGYILEDIDKKDGDLIYADDTAGWDTRITEDDLLNEELITEQMAPHHKTLAKAIFKLTYQNKVVKVLRPTPKGAVMDIISRKDQRGSGQVGTYGLNTFTNMEVQLIRQMEAEGVITQDDMQNPKGLKERVEKWLTECGVDRLKRMAISGDDCVVKPLDERFSTSLLFLNDMGKVRKDIPQWEPSKGWKNWQEVPFCSHHFHKIFMKDGRSLVVPCRNQDELIGRARISQGAGWSLRETACLGKAYAQMWSLMYFHRRDLRLASMAICSAVPTEWFPTSRTTWSIHAHHQWMTTEDMLKVWNRVWIEDNPNMTDKTPVYSWEDIPYLGKREDLWCGSLIGLSSRATWAKNIHTAITQVRNLIGKEDYVDYMPIMKRYSAPSESEGVL

SEQ ID NO: 5266 - protein, 3288 aa, Artificial Sequence
  derived and/or modified protein sequence (wt) from DENV-4__HQ332175__SS-prME
STITLLCLIPTVMAFHLSTRDGEPLMIVAKHERGRPLLFKTTEGINKCTLIAMDLGEMCEDTVTYKCPLLVNTEPEDIDCWCNLTSTWVMYGTCTQSGERRREKRSVALTPHSGMGLETRAETWMSSEGAWKHAQRVESWILRNPGFALLAGFMAYMIGQTGIQRTVFFVLMMLVAPSYGMRCVGVGNRDFVEGVSGGAWVDLVLEHGGCVTTMAQGKPTLDFELTKTTAKEVALLRTYCIEALISNITTATRCPTQGEPYLKEEQDQQYICRRDVVDRGWGNGCGLFGKGGVVTCAKFSCSGKITGNLVQIENLEYTVVVTVHNGDTHAVGNDTSNHGVTATITPRSPSVEVKLPDYGELTLDCEPRSGIDFNEMILMKMKKKTWLVHKQWFLDLPLPWTTGADTSEVHWNYKERMVTFKVPHAKRQDVTVLGSQEGAMHSALAGATEVDSGDGNHMFAGHLKCKVRMEKLRIKGMSYTMCSGKFSIDKEMAETQHGTTVVKVKYEGAGAPCKVPIEIRDVNKEKVVGRVISATPLAENTNSVTNIELEPPFGDSYIVIGVGNSALTLHWFRKGSSIGKMFESTYRGAKRMAILGETAWDFGSVGGLFTSLGKAVHQVFGSVYTTMFGGVSWMIRILIGFLVLWIGTNSRNTSMAMTCIAVGGITLFLGFTVQADMGCVVSWSGRELKCGSGIFVVDNVHTWTEQYKFQPESPARLASAILNAHKDGVCGIRSTTRLENVMWKQITNELNYVLWEGGHDLTVVAGDVKGVLTKGKRALTPPASDLKYSWKTWGKAKIFTPEARNSTFLIDGPDTSECPNERRAWNSFEVEDYGFGMFTTNIWMKFREGSSEVCDHRLMSAAIKDQKAVHADMGYWIESSKNQTWQIERASLIEVKTCLWPKTHTLWSNGVLESQMLIPKSYAGPFSQHNYRQGYATQTVGPWHLGKLEIDFGECPGTTVTIQENCDHRGPSLRTTTASGKLVTQWCCRSCTMPPLRFLGEDGCWYGMEIRPLSEKEENMVKSQVTAGQGTSETFSMGLLCLTLFVEECLRRRVTRKHMILAVVITLCAIILGGLTWMDLLRALIMLGDTMSGRIGGQTHLAIMAVFKMSPGYVLGVFLRKLTSRETALMVIGMAMTTTLSIPHDLMELIDGISLGLILLKIVTQFDNTQVGTLALSLTFIRSTMSLVMAWRTIMAVLFVVTLIPLCRTSCLQKQSHWVEITALILGAQALPVYLMTLMKGASRRSWPLNEGIMAVGLVSLLGSALLKNDVPLAGPMVAGGLLLAAYVMSGSSVDLSLEKAANVQWDEMADITGSSPIIEVKQDEDGSFSIRDVEETNMITLLVKLALITVSGLYPLAIPITMTLWYMWQVKTQRSGALWDVPSPAATQKAALSEGVYRIMQRGLFGKTQVGVGIHMEGVFHTMWHVTRGSVICHETGRLEPSWADVRNDMISYGGGWRLGDKWDKEEDVQVLAIEPGKNPKHVQTKPGLFKTLTGEIGAVTLDFKPGTSGSPIINRKGKVIGLYGNGVVTKSGDYVSAITQAERIGEPDYEVDEDIFRKKRLTIMDLHPGAGKTKRILPSIVREALKRRLRTLILAPTRVVAAEMEEALRGLPIRYQTPAVKSEHTGREIVDLMCHATFTTRLLSSTRVPNYNLIVMDEAHFTDPSSVAARGYISTRVEMGEAAAIFMTATPPGATDPFPQSNSPIEDIEREIPERSWNTGFDWITDYQGKTVWFVPSIKAGNDIANCLRKSGKKVIQLSRKTFDTEYPKTKLTDWDFVVTTDISEMGANFRAGRVIDPRRCLKPVILTDGPERVILAGPIPVTPASAAQRRGRIGRNPAQEDDQYVFSGDPLKNDEDHAHWTEAKMLLDNIYTPEGIIPTLFGPEREKTQAIDGEFRLRGEQRKTFVELMRRGDLPVWLSYKVASAGISYKDREWCFTGERNNQILEENMEVEIWTREGEKKKLRPKWLDARVYADPMALKDFKEFASGRKSITLDILTEIASLPTYLSSRAKLALDNIVMLHTTERGGRAYQHALNELPESLETLMLVALLGAMTAGIFLFFMQGKGIGKLSMGLITIAVASGLLWVAEIQPQWIAASIILEFFLMVLLIPEPEKQRTPQDNQLIYVILTILTIIGLIAANEMGLIEKTKTDFGFYQVKTETTILDVDLRPASAWTLYAVATTILTPMLRHTIENTSANLSLAAIANQAAVLMGLGKGWPLHRMDLGVPLLAMGCYSQVNPTTLTASLVMLLVHYAIIGPGLQAKATREAQKRTAAGIMKNPTVDGITVIDLEPISYDPKFEKQLGQVMLLVLCAGQLLLMRTTWAFCEVLTLATGPILTLWEGNPGRFWNTTIAVSTANIFRGSYLAGAGLAFSLIKNAQTPRRGTGTTGETLGEKWKRQLNSLDRKEFEEYKRSGILEVDRTEAKSALKDGSKIKHAVSRGSSKIRWIVERGMVKPKGKVVDLGCGRGGWSYYMATLKNVTEVKGYTKGGPGHEEPIPMATYGWNLVKLHSGVDVFYKPTEQVDTLLCDIGESSSNPTIEEGRTLRVLKMVEPWLSSKPEFCIKVLNPYMPTVIEELEKLQRKHGGNLVRCPLSRNSTHEMYWVSGASGNIVSSVNTTSKMLLNRFTTRHRKPTYEKDVDLGAGTRSVSTETEKPDMTIIGRRLQRLQEEHKETWHYDQENPYRTWAYHGSYEAPSTGSASSMVNGVVKLLTKPWDVIPMVTQLAMTDTTPFGQQRVFKEKVDTRTPQPKPGTRMVMTTTANWLWALLGKKKNPRLCTREEFISKVRSNAAIGAVFQEEQGWTSASEAVNDSRFWELVDKERALHQEGKCESCVYNMMGKREKKLGEFGRAKGSRAIWYMWLGARFLEFEALGFLNEDHWFGRENSWSGVEGEGLHRLGYILEEIDKKDGDLMYADDTAGWDTRITEDDLQNEELITEQMAPHHKILAKAIFKLTYQNKVVKVLRPTPRGAVMDIISRKDQRGSGQVGTYGLNTFTNMEVQLIRQMEAEGVITQDDMQNPKGLKERVEKWLRECGVDRLKRMAISGDDCVVKPLDERFGTSLLFLNDMGKVRKDIPQWEPSKGWKNWQEVPFCSHHFHKIFMKDGRSLVVPCRNQDELIGRARISQGAGWSLRETACLGKAYAQMWSLMYFHRRDLRLASMAICSAVPTEWFPTSRTTWSIHAHHQWMTTEDMLKVWNRVWIEDNPNMIDKTPVHSWEDIPYLGKREDLWCGSLIGLSSRATWAKNIHTAIAQVRNLIGKEEYVDYMPVMKRYSAPSESEGVL

SEQ ID NO: 5267 - protein, 3288 aa, Artificial Sequence
  derived and/or modified protein sequence (wt) from DENV-4__HQ332172__SS-prME
STITLLCLIPTVMAFHLSTRDGEPLMIVAKHERGRPLLFKTTEGINKCTLIAMDLGEMCEDTVTYKCPLLVNTEPEDIDCWCNLTSAWVMYGTCTQSGERRREKRSVALTPHSGMGLETRAETWMSSEGAWKHAQRVESWILRNPGFALLAGFMAYMIGQTGIQRTVFFVLMMLVAPSYGMRCVGVGNRDFVEGVSGGAWVDLVLEHGGCVTTMAQGKPTLDFELTKTTAKEVALLRTYCIEALISNITTATRCPTQGEPYLKEEQDQQYICRRDVVDRGWGNGCGLFGKGGVVTCAKFSCSGKITGNLVQIENLEYTVVVTVHNGDTHAVGNDTSNHGVTATITPRSPSVEVKLPDYGELTLDCEPRSGIDFNEMILMKMKKKTWLVHKQWFLDLPLPWTTGADTSEVHWNYKERMVTFKVPHAKRQDVTVLGSQEGAMHSALAGATEVDSGDGNHMFAGHLKCKVRMEKLRIKGMSYTMCSGKFSIDKEMAETQHGTTVVKVKYEGAGAPCKVPIEIRDVNKEKVVGRVISATPLAENTNSVTNIELEPPFGDSYIVIGVGNSALTLHWFRKGSSIGKMFESTYRGAKRMAILGETAWDFGSVGGLFTSLGKAVHQVFGSVYTTMFGGVSWMIRILIGFLVLWIGTNSRNTSMAMTCIAVGGITLFLGFTVQADMGCVVSWSGRELKCGSGIFVVDNVHTWTEQYKFQPESPARLASAILNAHKDGVCGIRSTTRLENVMWKQITNELNYVLWEGGHDLTVVAGDVKGVLTKGKRALTPPASDLKYSWKTWGKAKIFTPEARNSTFLIDGPDTSECPNERRAWNSFEVEDYGFGMFTTNIWMKFREGSSEVCDHRLMSAAIKDQKAVHADMGYWIESSKNQTWQIERASLIEVKTCLWPKTHTLWSNGVLESQMLIPKSYAGPFSQHNYRQGYATQTVGPWHLGKLEIDFGECPGTTVTIQENCDHRGPSLRTTTASGKLVTQWCCRSCTMPPLRFLGEDGCWYGMEIRPLSEKEENMVKSQVTAGQGTSETFSMGLLCLTLFVEECLRRRVTRKHMILAVVITLCAIILGGLTWMDLLRALIMLGDTMSGRIGGQTHLAIMAVFKMSPGYVLGVFLRKLTSRETALMVIGMAMTTTLSIPHDLMELIDGISLGLILLKIVTQFDNTQVGTLALSLTFIRSTMSLVMAWRTIMAVLFVVTLIPLCRTSCLQKQSHWVEITALILGAQALPVYLMTLMKGASRRSWPLNEGIMAVGLVSLLGSALLKNDVPLAGPMVAGGLLLAAYVMSGSSADLSLEKAANVQWDEMADITGSSPIIEVKQDEDGSFSIRDVEETNMITLLVKLALITVSGLYPLAIPITMTLWYMWQVKTQRSGALWDVPSPTATQKAALSEGVYRIMQRGLFGKTQVGVGIHMEGVFHTMWHVTRGSVICHETGRLEPSWADVRNDMISYGGGWRLGDKWDKEEDVQVLAIEPGKNPKHVQTKPGLFKTLTGEIGAVTLDFKPGTSGSPIINRKGKVIGLYGNGVVTKSGDYVSAITQAERIGEPDYEVDEDIFRKKRLTIMDLHPGAGKTKRILPSIVREALKRRLRTLILAPTRVVAAEMEEALRGLPIRYQTPAVKSEHTGREIVDLMCHATFTTRLLSSTRVPNYNLIVMDEAHFTDPSSVAARGYISTRVEMGEAAAIFMTATPPGATDPFPQSNSPIEDIEREIPERSWNTGFDWITDYQGKTVWFVPSIKAGNDIANCLRKSGKKVIQLSRKTFDTEYPKTKLTDWDFVVTTDISEMGANFRAGRVIDPRRCLKPVILTDGPERVILAGPIPVTPASAAQRRGRIGRNPAQEDDQYVFSGDPLKNDEDHAHWTEAKMLLDNIYTPEGIIPTLFGPEREKTQAIDGEFRLRGEQRKTFVELMRRGDLPVWLSYKVASAGISYKDREWCFTGERNNQILEENMEVEIWTREGEKKKLRPKWLDARVYADPMALKDFKEFASGRKSITLDILTEIASLPTYLSSRAKLALDNIVMLHTTERGGRAYQHALNELPESLETLMLVALLGAMTAGIFLFFMQGKGIGKLSMGLITIAVASGLLWVAEIQPQWIAASIILEFFLMVLLIPEPEKQRTPQDNQLIYVILTILTIIGLIAANEMGLIEKTKTDFGFYQVKTETTILDVDLRPASAWTLYAVATTILTPMLRHTIENTSANLSLAAIANQAAILMGLGKGWPLHRMDLGVPLLAMGCYSQVNPTTLTASLVMLLVHYAIIGPGLQAKATREAQKRTAAGIMKNPTVDGITVIDLEPISYDPKFEKQLGQVMLLALCAGQLLLMRTTWAFCEVLTLATGPILTLWEGNPGRFWNTTIAVSTANIFRGSYLAGAGLAFSLIKNAQTPRRGTGTTGETLGEKWKRQLNSLDRKEFEEYKRSGILEVDRTEAKSALKDGSKIKHAVSRGSSKIRWIVERGMVKPKGKVVDLGCGRGGWSYYMATLKNVTEVKGYTKGGPGHEEPIPMATYGWNLVKLHSGVDVFYKPTEQVDTLLCDIGESSSNPTIEEGRTLRVLKMVEPWLSSKPEFCIKVLNPYMPTVIEELEKLQRKHGGNLVRCPLSRNSTHEMYWVSGASGNIVSSVNTTSKMLLNRFTTRHRKPTYEKDVDLGAGTRSVSTETEKPDMTIIGRRLQRLQEEHKETWHYDQENPYRTWAYHGSYEAPSTGSASSMVNGVVKLLTKPWDVIPMVTQLAMTDTTPFGQQRVFKEKVDTRTPQPKPGTRMVMTTTANWLWALLGKKKNPRLCTREEFISKVRSNAAIGAVFQEEQGWTSASEAVNDSRFWELVDKERALHQEGKCESCVYNMMGKREKKLGEFGRAKGSRAIWYMWLGARFLEFEALGFLNEDHWFGRENSWSGVEGEGLHRLGYILEEIDKKDGDLMYADDTAGWDTRITEDDLQNEELITEQMAPHHKILAKAIFKLTYQNKVVKVLRPTPRGAVMDIISRKDQRGSGQVGTYGLNTFTNMEVQLIRQMEAEGVITQDDMQNPKGLKERVEKWLRECGVDRLKRMAISGDDCVVKPLDERFGTSLLFLNDMGKVRKDIPQWEPSKGWKNWQEVPFCSHHFHKIFMKDGRSLVVPCRNQDELIGRARISQGAGWSLRETACLGKAYAQMWSLMYFHRRDLRLASMAICSAVPTEWFPTSRTTWSIHAHHQWMTTEDMLKVWNRVWIEDNPNMIDKTPVHSWEDIPYLGKREDLWCGSLIGLSSRATWAKNIHTAITQVRNLIGKEEYVDYMPVMKRYSAPSESEGVL

SEQ ID NO: 5268 - protein, 3288 aa, Artificial Sequence
  derived and/or modified protein sequence (wt) from DENV-4__HQ332176__SS-prME
STITLLCLIPTVMAFHLSTRDGEPLMIVARHERGRPLLFKTTEGINKCTLIAMDLGEMCEDTVTYKCPLLVNTEPEDIDCWCNLTSTWVMYGTCTQSGERRREKRSVALTPHSGMGLETRAETWMSSEGAWKHAQRVESWILRNPGFALLAGFMAYMIGQTGIQRTVFFVLMMLVAPSYGMRCVGVGNRDFVEGVSGGAWVDLVLEHGGCVTTMAQGKPTLDFELTKTTAKEVALLRTYCIEALISNITTATRCPTQGEPYLKEEQDQQYICRRDVVDRGWGNGCGLFGKGGVVTCAKFSCSGKITGNLVQIENLEYTVVVTVHNGDTHAVGNDTSNHGVTATITPRSPSVEVKLPDYGELTLDCEPRSGIDFNEMILMKMKKKTWLVHKQWFLDLPLPWTTGADTSEVHWNYKERMVTFKVPHAKRQDVTVLGSQEGAMHSALAGATEVDSGDGNHMFAGHLKCKVRMEKLRIKGMSYTMCSGKFSIDKEMAETQHGTTVVKVKYEGAGAPCKVPIEIRDVNKEKVVGRVISATPLAENTNSVTNIELEPPFGDSYIVIGVGNSALTLHWFRKGSSIGKMFESTYRGAKRMAILGETAWDFGSVGGLFTSLGKAVHQVFGSVYTTMFGGVSWMIRILIGFLVLWIGTNSRNTSMAMTCIAVGGITLFLGFTVQADMGCVVSWSGRELKCGSGIFVVDNVHTWTEQYKFQPESPARLASAILNAHKDGVCGIRSTTRLENVMWKQITNELNYVLWEGGHDLTVVAGDVKGVLTKGKRALTPPASDLKYSWKTWGKAKIFTPEARNSTFLIDGPDTSECPNERRAWNSFEVEDYGFGMFTTNIWMKFREGSSEVCDHRLMSAAIKDQKAVHADMGYWIESSKNQTWQIERASLIEVKTCLWPKTHTLWSNGVLESQMLIPKSYAGPFSQHNYRQGYATQTVGPWHLGKLEIDFGECPGTTVTIQENCDHRGPSLRTTTASGKLVTQWCCRSCTMPPLRFLGEDGCWYGMEIRPLSEKEENMVKSQVTAGQGTSETFSMGLLCLTLFVEECLRRRVTRKHMILAVVITLCAIILGGLTWMDLLRALIMLGDTMSGRIGGQTHLAIMAVFKMSPGYVLGVFLRKLTSRETALMVIGMAMTTTLSIPHDLMELIDGISLGLILLKIVTQFDNTQVGTLALSLTFIRSTMSLVMAWRTIMAVLFVVTLIPLCRTSCLQKQSHWVEITALILGAQALPVYLMTLMKGASRRSWPLNEGIMAVGLVSLLGSALLKNDVPLAGPMVAGGLLLAAYVMSGSSADLSLEKAANVQWDEMADITGSSPIIEVKQDEDGSFSIRDVEETNMITLLVKLALITVSGLYPLAIPITMTLWYMWQVKTQRSGALWDVPSPAATQKAALSEGVYRIMQRGLFGKTQVGVGIHMEGVFHTMWHVTRGSVICHETGRLEPSWADVRNDMISYGGGWRLGDKWDKEEDVQVLAIEPGKNPKHVQTKPGLFKTLTGEIGAVTLDFKPGTSGSPIINRKGKVIGLYGNGVVTKSGDYVSAITQAERIGEPDYEVDEDIFRKKRLTIMDLHPGAGKTKRILPSIVREALKRRLRTLILAPTRVVAAEMEEALRGLPIRYQTPAVKSEHTGREIVDLMCHATFTTRLLSSTRVPNYNLIVMDEAHFTDPSSVAARGYISTRVEMGEAAAIFMTATPPGATDPFPQSNSPIEDIEREIPERSWNTGFDWITDYQGKTVWFVPSIKAGNDIANCLRKSGKKVIQLSRKTFDTEYPKTKLTDWDFVVTTDISEMGANFRAGRVIDPRRCLKPVILTDGPERVILAGPIPVTPASAAQRRGRIGRNPAQEDDQYVFSGDPLKNDEDHAHWTEAKMLLDNIYTPEGIIPTLFGPEREKTQAIDGEFRLRGEQRKTFVELMRRGDLPVWLSYKVASAGISYKDREWCFTGERNNQILEENMEVEIWTREGEKKKLRPKWLDARVYADPMALKDFKEFASGRKSITLDILTEIASLPTYLSSRAKLALDNIVMLHTTERGGRAYQHALNELPESLETLMLVALLGAMTAGIFLFFMQGKGIGKLSMGLITIAVASGLLWVAEIQPQWIAASIILEFFLMVLLIPEPEKQRTPQDNQLIYVILTILTIIGLIAANEMGLIEKTKTDFGFYQVKTETTILDVDLRPASAWTLYAVATTILTPMLRHTIENTSANLSLAAIANQAAVLMGLGKGWPLHRMDLGVPLLAMGCYSQVNPTTLTASLVMLLVHYAIIGPGLQAKATREAQKRTAAGIMKNPTVDGITVIDLEPISYDPKFEKQLGQVMLLVLCAGQLLLMRTTWAFCEVLTLATGPILTLWEGNPGRFWNTTIAVSTANIFRGSYLAGAGLAFSLIKNAQTPRRGTGTTGETLGEKWKRQLNSLDRKEFEEYKRSGILEVDRTEAKSALKDGSKIKHAVSRGSSKIRWIVERGMVKPKGKVVDLGCGRGGWSYYMATLKNVTEVKGYTKGGPGHEEPIPMATYGWNLVKLHSGVDVFYKPTEQVDTLLCDIGESSSNPTIEEGRTLRVLKMVEPWLSSKPEFCIKVLNPYMPTVIEELEKLQRKHGGNLVRCPLSRNSTHEMYWVSGASGNIVSSVNTTSKMLLNRFTTRHRKPSYEKDVDLGAGTRSVSTETEKPDMTIIGRRLQRLQEEHKETWHYDQENPYRTWAYHGSYEAPSTGSASSMVNGVVKLLTKPWDVIPMVTQLAMTDTTPFGQQRVFKEKVDTRTPQPKPGTRMVMTTTANWLWALLGKKKNPRLCTREEFISKVRSNAAIGAVFQEEQGWTSASEAVNDSRFWELVDKERALHQEGKCESCVYNMMGKREKKLGEFGRAKGSRAIWYMWLGARFLEFEALGFLNEDHWFGRENSWSGVEGEGLHRLGYILEEIDKKDGDLMYADDTAGWDTRITEDDLQNEELITEQMAPHHKILAKAIFKLTYQNKVVKVLRPTPRGAVMDIISRKDQRGSGQVGTYGLNTFTNMEVQLIRQMEAEGVITQDDMQNPKGLKERVEKWLRECGVDRLKRMAISGDDCVVKPLDERFGTSLLFLNDMGKVRKDIPQWEPSKGWKNWQEVPFCSHHFHKIFMKDGRSLVVPCRNQDELIGRARISQGAGWSLRETACLGKAYAQMWSLMYFHRRDLRLASMAICSAVPTEWFPTSRTTWSIHAHHQWMTTEDMLKVWNRVWIEDNPNMIDKTPVHSWEDIPYLGKREDLWCGSLIGLSSRATWAKNIHTAITQVRNLIGKEEYVDYMPVMKRYSAPSESEGVL

SEQ ID NO: 5269 - protein, 3288 aa, Artificial Sequence
  derived and/or modified protein sequence (wt) from DENV-4__HQ332174__SS-prME
STITLLCLIPTAMAFHLSTRDGEPLMIVAKHERGRPLLFKTTEGINKCTLIAMDLGEMCEDTVTYKCPLLVNTEPEDIDCWCNLTSTWVMYGTCTQSGERRREKRSVALTPHSGMGLETRAETWMSSEGAWKHAQRVESWILRNPGFALLAGFMAYMIGQTGIQRTVFFVLMMLVAPSYGMRCVGVGNRDFVEGVSGGAWVDLVLEHGGCVTTMAQGKPTLDFELTKTTAKEVALLRTYCIEALISNITTATRCPTQGEPYLKEEQDQQYICRRDVVDRGWGNGCGLFGKGGVVTCAKFSCSGKITGNLVQIENLEYTVVVTVHNGDTHAVGNDTSNHGVTATITPRSPSVEVKLPDYGELTLDCEPRSGIDFNEMILMKMKKKTWLVHKQWFLDLPLPWTTGADTSEVHWNYKERMVTFKVPHAKRQDVTVLGSQEGAMHSALAGATEVDSGDGNHMFAGHLKCKVRMEKLRIKGMSYTMCSGKFSIDKEMAETQHGTTVVKVKYEGAGAPCKVPIEIRDVNKEKVVGRVISATPLAENTNSVTNIELEPPFGDSYIVIGVGNSALTLHWFRKGSSIGKMFESTYRGAKRMAILGETAWDFGSVGGLFTSLGKAVHQVFGSVYTTMFGGVSWMIRILIGFLVLWIGTNSRNTSMAMTCIAVGGITLFLGFTVQADMGCVVSWSGRELKCGSGIFVVDNVHTWTEQYKFQPESPARLASAILNAHKDGVCGIRSTTRLENVMWKQITNELNYVLWEGGHDLTVVAGDVKGVLTKGKRALTPPASDLKYSWKTWGKAKIFTPEARNSTFLIDGPDTSECPNERRAWNSFEVEDYGFGMFTTNIWMKFREGSSEVCDHRLMSAAIKDQKAVHADMGYWIESSKNQTWQIERASLIEVKTCLWPKTHTLWSNGVLESQMLIPKSYAGPFSQHNYRQGYATQTMGPWHLGKLEIDFGECPGTTVTIQENCDHRGPSLRTTTASGKLVTQWCCRSCTMPPLRFLGEDGCWYGMEIRPLSEKEENMVKSQVTAGQGASETFSMGLLCLTLFVEECLRRRVTRKHMILAVVITLCAIILGGLTWMDLLRALIMLGDTMSGRIGGQTHLAIMAVFKMSPGYVLGVFLRKLTSRETALMVIGMAMTTTLSIPHDLMELIDGISLGLILLKIVTQFDNTQVGTLALSLTFIRSTMSLVMAWRTIMAVLFVVTLIPLCRTSCLQKQSHWVEITALILGAQALPVYLMTLMKGASRRSWPLNEGIMAVGLVSLLGSALLKNDVPLAGPMVAGGLLLAAYVMSGSSADLSLEKAANVQWDEMADITGSSPIIEVKQDEDGSFSIRDVEETNMITLLVKLALITVSGLYPLAIPITMTLWYMWQVKTQRSGALWDVPSPAATQKAALSEGVYRIMQRGLFGKTQVGVGIHMEGVFHTMWHVTRGSVICHETGRLEPSWADVRNDMISYGGGWRLGDKWDKEEDVQVLAIEPGKNPKHVQTKPGLFKTLTGEIGAVTLDFKPGTSGSPIINRKGKVIGLYGNGVVTKSGDYVSAITQAERIGEPDYEVDEDIFRKKRLTIMDLHPGAGKTKRILPSIVREALKRRLRTLILAPTRVVAAEMEEALRGLPIRYQTPAVKSEHTGREIVDLMCHATFTTRLLSSTRVPNYNLIVMDEAHFTDPSSVAARGYISTRVEMGEAAAIFMTATPPGATDPFPQSNSPIEDIEREIPERSWNTGFDWITDYQGKTVWFVPSIKAGNDIANCLRKSGKKVIQLSRKTFDTEYPKTKLTDWDFVVTTDISEMGANFRAGRVIDPRRCLKPVILTDGPERVILAGPIPVTPASAAQRRGRIGRNPAQEDDQYVFSGDPLKNDEDHAHWTEAKMLLDNIYTPEGIIPTLFGPEREKTQAIDGEFRLRGEQRKTFVELMRRGDLPVWLSYKVASAGISYKDREWCFTGERNNQILEENMEVEIWTREGEKKKLRPKWLDARVYADPMALKDFKEFASGRKSITLDILTEIASLPTYLSSRAKLALDNIVMLHTTERGGRAYQHALNELPESLETLMLVALLGAMTAGIFLFFMQGKGIGKLSMGLITIAVASGLLWVAEIQPQWIAASIILEFFLMVLLIPEPEKQRTPQDNQLIYVILTILTIIGLIAANEMGLIEKTKTDFGFYQAKTETTILDVDLRPASAWTLYAVATTILTPMLRHTIENTSANLSLAAIANQAAVLMGLGKGWPLHRMDLGVPLLAMGCYSQVNPTTLTASLVMLLVHYAIIGPGLQAKATREAQKRTAAGIMKNPTVDGITVIDLEPISYDPKFEKQLGQVMLLVLCAGQLLLMRTTWAFCEVLTLATGPILTLWEGNPGRFWNTTIAVSTANIFRGSYLAGAGLAFSLIKNAQTPRRGTGTTGETLGEKWKRQLNSLDRKEFEEYKRSGILEVDRTEAKSALKDGSKIKHAVSRGSSKIRWIVERGMVKPKGKVVDLGCGRGGWSYYMATLKNVTEVKGYTKGGPGHEEPIPMATYGWNLVKLHSGVDVFYKPTEQVDTLLCDIGESSSNPTIEEGRTLRVLKMVEPWLSSKPEFCIKVLNPYMPTVIEELEKLQRKHGGNLVRCPLSRNSTHEMYWVSGASGNIVSSVNTTSKMLLNRFTTRHRKPTYEKDVDLGAGTRSVSTETEKPDMTIIGRRLQRLQEEHKETWHYDQENPYRTWAYHGSYEAPSTGSASSMVNGVVKLLTKPWDVIPMVTQLAMTDTTPFGQQRVFKEKVDTRTPQPKPGTRTVMTTTANWLWALLGKKKNPRLCTREEFISKVRSNAAIGAVFQEEQGWTSASEAVNDSRFWELVDKERALHQEGKCESCVYNMMGKREKKLGEFGRAKGSRAIWYMWLGARFLEFEALGFLNEDHWFGRENSWSGVEGEGLHRLGYILEEIDKKDGDLMYADDTAGWDTRITEDDLQNEELITEQMAPHHKILAKAIFKLTYQNKVVKVLRPTPRGAVMDIISRKDQRGSGQVGTYGLNTFTNMEVQLIRQMEAEGVITQDDMQNPKGLKERVEKWLRECGVDRLKRMAISGDDCVVKPLDERFGTSLLFLNDMGKVRKDIPQWEPSKGWKNWQEVPFCSHHFHKIFMKDGRSLVVPCRNQDELIGRARISQGAGWSLRETACLGKAYAQMWSLMYFHRRDLRLASMAICSAVPTEWFPTSRTTWSIHAHHQWMTTEDMLKVWNRVWIEDNPNMIDKTPVHSWEDIPYLGKREDLWCGSLIGLSSRATWAKNIHTAITQVRNLIGKEEYVDYMPVMKRYSAPSESEGVL

SEQ ID NO: 5270 - protein, 3288 aa, Artificial Sequence
  derived and/or modified protein sequence (wt) from DENV-4__KT026308__SS-prME
STITLLCLIPTVMAFHLSTRDGEPLMIVAKHERGRPLLFKTTEGINKCTLIAMDLGEMCEDTVTYKCPLLVNTEPEDIDCWCNLTSTWVMYGTCTQSGERRREKRSVALTPHSGMGLETRAETWMSSEGAWKHAQRVESWILRNPGFALLAGFMAYMIGQTGIQRTVFFILMMLVAPSYGMRCVGVGNRDFVEGVSGGAWVDLVLEHGGCVTTMAQGKPTLDFELIKTTAKEVALLRTYCIEASISNITTATRCPTQGEPYLKEEQDQQYICRRDMVDRGWGNGCGLFGKGGVVTCAKFSCLGKITGNLVQIENLEYTVVVTVHNGDTHAVGNDTSNHGVTATITPRSPSVEVQLPDYGELTLDCEPRSGIDFNEMILMKMKTKTWLVHKQWFLDLPLPWTTGADTLEVHWNHKERMVTFKVPHAKRQDVTVLGSQEGAMHSALAGATEVDSGDGNHMFAGHLKCKVRMEKLRIKGMSYTMCSGKFSIDKEMAETQHGTTVVKVKYEGTGAPCKVPIEIRDVNKEKVVGRIISSTPFAENTNSVTNIELEPPFGDSYIVIGVGDSALTLHWFRKGSSIGKMFESTYRGAKRMAILGETAWDFGSVGGLLTSLGKAVHQVFGSVYTTMFGGVSWMVRILIGLLVLWIGTNSRNTSMAMSCIAVGGITLFLGFTVHADMGCVVSWSGKELKCGSGIFVIDNVHTWTEQYKFQPESPARLASAILNAHKEGVCGIRSTTRLENVMWKQITNELNYVLWEGGHDLTVVAGDVKGVLSKGKRALAPPVNDLKYSWKTWGKAKIFTPETRNSTFLVDGPDTSECPNERRAWNFLEVEDYGFGMFTTNIWMKFREGSSEVCDHRLMSAAIKDQKAVHADMGYWIESSKNQTWQIEKASLIEVKTCLWPKTHTLWSNGVLESQMLIPKAYAGPISQHNYRQGYATQTAGPWHLGKLEIDFGECPGTTVTVQEDCDHRGPSLRTTTASGKLVTQWCCRSCTMPPLRFLGEDGCWYGMEIRPLNEKEENMVKSQVSAGHGTSETFSMGLLCLTLFVEECLRRRVTRKHMILVVVTTLCAIILGGLTWMDLLRALIMLGDTMSGRMGGQIHLAIMAVFKMSPGYVLGIFLRKLTSRETALMVIGMAMTTVLSIPHDLMEFIDGISLGLILLKMVTHFDNTQVGTLALALTFIKSTMPLVMAWRTIMAVLFVVTLIPLCRTSCLQKQSHWVEITALILGAQALPVYLMTLMKGASKRSWPLNEGIMAVGLVSLLGSALLKNDVPLAGPMVAGGLLLAAYVMSGSSADLSLEKAANVQWDEMADITGSSPIIEVKQDEDGSFSIRDVEETNMITLLVKLALITVSGLYPLAIPVTMTLWYMWQVKTQRSGALWDVPSPAAAQKATLTEGVYRIMQRGLFGKTQVGVGIHTEGVFHTMWHVTRGSVICHESGRLEPSWADVRNDMISYGGGWRLGDKWDKEEDVQVLAIEPGKNPKHVQTKPGLFKTLTGEIGAVTLDFKPGTSGSPIINRKGKVIGLYGNGVVTKSGDYVSAITQAERIGEPDYEVDEDIFRKKRLTIMDLHPGAGKTKRILPSIVREALKRRLRTLILAPTRVVAAEMEEALRGLPIRYQTPAVKSEHTGREIVDLMCHATFTTRLLSSTRVPNYNLIVMDEAHFTDPSSVAARGYISTRVEMGEAAAVFMTATPPGTTDPFPQSNSPIEDIEREIPERSWNTGFDWITDYQGKTVWFVPSIKAGNDIANCLRKSGKKVIQLSRKTFDTEYPKTKLTDWDFVITTDISEMGANFRAGRVIDPRRCLKPVILTDGPERVILAGPIPVTPASAAQRRGRIGRNPAQEDDQYVFSGDPLRNDEDHAHWTEAKMLLDNIYTPEGIIPTLFGPEREKTQAIDGEFRLRGEQRKTFVELMRRGDLPVWLSHKVASAGISYKDREWCFTGERNNQILEENMEVEIWTREGEKKKLRPKWLDARVYADPMALKDFKEFASGRKSITLDILTEIASLPTYLSSRAKLALDNIVMLHTTERGGKAYQHALNELPESLETLMLVALLGAMTAGIFLFFMQGKGMGKLSMGLIAIAVASGLLWVAEIQPQWIAASIILEFFLMVLLVPEPEKQRTPQDNQLIYVILTILTIIALVAANEMGLIEKTKTDFGFYQVKAETTILDVDLRPASAWTLYAVATTILTPMLRHTIENTSANLSLAAIANQAAVLMGLGKGWPLHRMDLGVPLLAMGCYSQVNPTTLTASLVMLLVHYAIIGPGLQAKATREAQKRTAAGIMKNPTVDGITVIDLEPISYDPKFEKQLGQVMLLVLCVGQLLLMRTTWAFCEVLTLATGPILTLWEGNPGRFWNTTIAVSTANIFRGSYLAGAGLAFSLIKNAQTPRRGTGTMGETLGEKWKRQLNSLDRKEFEEYKRSGILEVDRTEARSALKDGSKIKYAVSRGTSKIRWIVERGMVKPKGKVVDLGCGRGGWSYYMATLKNVTEVKGYTKGGPGHEEPIPMATYGWNLVKLHSGVDVFYKPTEQVDTLLCDIGESSSNPTIEEGRTLRVLKMVEPWLSSKPEFCIKVLNPYMPTVIEELEKLQRRHGGSLVRCPLSRNSTHEMYWVSGVSGNIVSSVNTTSKMLLNRFTTRHRKPTYEKDADLGAGTRSVSTETEKPDMTIIGRRLQRLQEEHKETWHYDHENPYRTWAYHGSYEAPSTGSASSMVNGVVKLLTKPWDVVPMVTQLAMTDTTPFGQQRVFKEKVDTRTPQPKPGTQVVMTTTANWLWTLLGRKKNPRLCTREEFISKVRSNAAIGAVFQEEQGWTSASEAVNDSRFWELVDKERALHQEGKCESCVYNMMGKREKKLGEFGRAKGSRAIWYMWLGARFLEFEALGFLNEDHWFGRENSWSGVEGEGLHRLGYILEDIDKKDGDLIYADDTAGWDTRITEDDLLNEELITEQMTPHHKILAKAIFKLTYQNKVVKVLRPTPKGAVMDIISRKDQRGSGQVGTYGLNTFTNMEVQLIRQMEAEGVITRDDMHNPKGLKERVEKWLKECGVDRLKRMAISGDDCVVKPLDERFSTSLLFLNDMGKVRKDIPQWEPSKGWKNWQEVPFCSHHFHKIFMKDGRSLVVPCRNQDELIGRARISQGAGWSLRETACLGKAYAQMWSLMYFHRRDLRLASMAICSAVPTEWFPTSRTTWSIHAHHQWMTTEDMLKVWNRVWIEDNPNMIDKTPVHSWEDIPYLGKREDLWCGSLIGLSSRATWAKNIHTAITQVRNLIGKEEYVDYMPAMRRYSAHFESEGVL

SEQ ID NO: 5271 - protein, 3288 aa, Artificial Sequence
  derived and/or modified protein sequence (wt) from DENV-4__KT026309__SS-prME
STITLLCLIPTVMAFHLSTRDGEPLMIVAKHERGRPLLFKTTEGINKCTLIAMDLGEMCEDTVTYKCPLLVNTEPEDIDCWCNLTSTWVMYGTCTQSGERRREKRSVALTPHSGMGLETRAETWMSSEGAWKHAQRVESWILRNPGFALLAGFMAYMIGQTGIQRTVFFILMMLVAPSYGMRCVGVGNRDFVEGVSGGAWVDLVLEHGGCVTTMAQGKPTLDFELIKTTAKEVALLRTYCIEASISNITTATRCPTQGEPYLKEEQDQQYICRRDMVDRGWGNGCGLFGKGGVVTCAKFSCLGKITGNLVQIENLEYTVVVTVHNGDTHAVGNDTSNHGVTATITPRSPSVEVQLPDYGELTLDCEPRSGIDFNEMILMKMKTKTWLVHKQWFLDLPLPWTTGADTLEVHWNHKERMVTFKVPHAKRQDVTVLGSQEGAMHSALAGATEVDSGDGNHMFAGHLKCKVRMEKLRIKGMSYTMCSGKFSIDKEMAETQHGTTVVKVKYEGTGAPCKVPIEIRDVNKEKVVGRIISSTPFAENTNSVTNIELEPPFGDSYIVIGVGDSALTLHWFRKGSSIGKMFESTYRGAKRMAILGETAWDFGSVGGLLTSLGKAVHQVFGSVYTTMFGGVSWMVRILIGLLVLWIGTNSRNTSMAMSCIAVGGITLFLGFTVHADMGCVVSWSGKELKCGSGIFVIDNVHTWTEQYKFQPESPARLASAILNAHKEGVCGIRSTTRLENVMWKQITNELNYVLWEGGHDLTVVAGDVKGVLSKGKRALAPPVNDLKYSWKTWGKAKIFTPETRNSTFLVDGPDTSECPNERRAWNFLEVEDYGFGMFTTNIWMKFREGSSEVCDHRLMSAAIKDQKAVHADMGYWIESSKNQTWQIEKASLIEVKTCLWPKTHTLWSNGVLESQMLIPKAYAGPISQHNYRQGYATQTAGPWHLGKLEIDFGECPGTTVTVQEDCDHRGPSLRTTTASGKLVTQWCCRSCTMPPLRFLGEDGCWYGMEIRPLNEKEENMVKSQVSAGHGTSETFSMGLLCLTLFVEECLRRRVTRKHMILVVVTTLCAIILGGLTWMDLLRALIMLGDTMSGRMGGQIHLAIMAVFKMSPGYVLGIFLRKLTSRETALMVIGMAMTTVLSIPHDLMEFIDGISLGLILLKMVTHFDNTQVGTLALALTFIKSTMPLVMAWRTIMAVLFVVTLIPLCRTSCLQKQSHWVEITALILGAQALPVYLMTLMKGASKRSWPLNEGIMAVGLVSLLGSALLKNDVPLAGPMVAGGLLLAAYVMSGSSADLSLEKAANVQWDEMADITGSSPIIEVKQDEDGSFSIRDVEETNMITLLVKLALITVSGLYPLAIPVTMTLWYMWQVKTQRSGALWDVPSPAAAQKATLTEGVYRIMQRGLFGKTQVGVGIHTEGVFHTMWHVTRGSVICHESGRLEPSWADVRNDMISYGGGWRLGDKWDKEEDVQVLAIEPGKNPKHVQTKPGLFKTLTGEIGAVTLDFKPGTSGSPIINRKGKVIGLYGNGVVTKSGDYVSAITQAERIGEPDYEVDEDIFRKKRLTIMDLHPGAGKTKRILPSIVREALKRRLRTLILAPTRVVAAEMEEALRGLPIRYQTPAVKSEHTGREIVDLMCHATFTTRLLSSTRVPNYNLIVMDEAHFTDPSSVAARGYISTRVEMGEAAAVFMTATPPGTTDPFPQSNSPIEDIEREIPERSWNTGFDWITDYQGKTVWFVPSIKAGNDIANCLRKSGKKVIQLSRKTFDTEYPKTKLTDWDFVITTDISEMGANFRAGRVIDPRRCLKPVILTDGPERVILAGPIPVTPASAAQRRGRIGRNPAQEDDQYVFSGDPLRNDEDHAHWTEAKMLLDNIYTPEGIIPTLFGPEREKTQAIDGEFRLRGEQRKTFVELMRRGDLPVWLSHKVASAGISYKDREWCFTGERNNQILEENIEVEIWTREGEKKKLRPKWLDARVYADPMALKDFKEFASGRKSITLDILTEIASLPTYLSSRAKLALDNIVMLHTTERGGKAYQHALNELPESLETLMLVALLGAMTAGIFLFFMQGKGMGKLSMGLIAIAVASGLLWVAEIQPQWIAASIILEFFLMVLLVPEPEKQRTPQDNQLIYVILTILTIIALVAANEMGLIEKTKTDFGFYQVKAETTILDVDLRPASAWTLYAVATTILTPMLRHTIENTSANLSLAAIANQAAVLMGLGKGWPLHRMDLGVPLLAMGCYSQVNPTTLTASLVMLLVHYAIIGPGLQAKATREAQKRTAAGIMKNPTVDGITVIDLEPISYDPKFEKQLGQVMLLVLCVGQLLLMRTTWAFCEVLTLATGPILTLWEGNPGRFWNTTIAVSTANIFRGSYLAGAGLAFSLIKNAQTPRRGTGTMGETLGEKWKRQLNSLDRKEFEEYKRSGILEVDRTEARSALKDGSKIKYAVSRGTSKIRWIVERGMVKPKGKVVDLGCGRGGWSYYMATLKNVTEVKGYTKGGPGHEEPIPMATYGWNLVKLHSGVDVFYKPTEQVDTLLCDIGESSSNPTIEEGRTLRVLKMVEPWLSSKPEFCIKVLNPYMPTVIEELEKLQRRHGGSLVRCPLSRNSTHEMYWVSGVSGNIVSSVNTTSKMLLNRFTTRHRKPTYEKDADLGAGTRSVSTETEKPDMTIIGRRLQRLQEEHKETWHYDHENPYRTWAYHGSYEAPSTGSASSMVNGVVKLLTKPWDVVPMVTQLAMTDTTPFGQQRVFKEKVDTRTPQPKPGTQVVMTTTANWLWTLLGRKKNPRLCTREEFISKVRSNAAIGAVFQEEQGWTSASEAVNDSRFWELVDKERALHQEGKCESCVYNMMGKREKKLGEFGRAKGSRAIWYMWLGARFLEFEALGFLNEDHWFGRENSWSGVEGEGLHRLGYILEDIDKKDGDLIYADDTAGWDTRITEDDLLNEELITEQMTPHHKILAKAIFKLTYQNKVVKVLRPTPKGAVMDIISRKDQRGSGQVGTYGLNTFTNMEVQLIRQMEAEGVITRDDMHNPKGLKERVEKWLKECGVDRLKRMAISGDDCVVKPLDERFSTSLLFLNDMGKVRKDIPQWEPSKGWKNWQEVPFCSHHFHKIFMKDGRSLVVPCRNQDELIGRARISQGAGWSLRETACLGKAYAQMWSLMYFHRRDLRLASMAICSAVPTEWFPTSRTTWSIHAHHQWMTTEDMLKVWNRVWIEDNPNMIDKTPVHSWEDIPYLGKREDLWCGSLIGLSSRATWAKNIHTAITQVRNLIGKEEYVDYMPAMRRYSAHFESEGVL

SEQ ID NO: 5272 - protein, 3288 aa, Artificial Sequence
  derived and/or modified protein sequence (wt) from DENV-4__KF907503__SS-prME
STITLLCLIPTVMAFHLSTRDGEPLMIVAKHERGRPLLFKTTEGINKCTLIAMDLGEMCEDTVTYKCPLLVNTEPEDIDCWCNLTSTWVMYGTCTQSGERRREKRSVALTPHSGMGLETRAETWMSSEGAWKHAQRVESWILRNPGFALLAGFMAYMIGQTGIQRTVFFVLMMLVAPSYGMRCVGVGNRDFVEGVSGGAWVDLVLEHGGCVTTMAQGKPTLDFELTKTTAKEVALLRTYCIEASISNITTATRCPTQGEPYLKEEQDQQYICRRDVVDRGWGNGCGLFGKGGVVTCAKFSCSGKITGNLVQIENLEYTVVVTVHNGDTHAVGNDTSNHGVTAMITPRSPSVEVKLPDYGELTLDCEPRSGIDFNEMILMKMKKKTWLVHKQWFLDLPLPWTAGADTSEVHWNYKERMVTFKVPHAKRQDVTVLGSQEGAMHSALAGATEVDSGDGNHMFAGHLKCKVRMEKLRIKGMSYTMCSGKFSIDKEMAETQHGTTVVKVKYEGAGAPCKVPIEIRDVNKEKVVGRIISSTPLAENTNSVTNIELEPPFGDSYIVIGVGNSALTLHWFRKGSSIGKMFESTYRGAKRMAILGETAWDFGSVGGLFTSLGKAVHQVFGSVYTTMFGGVSWMIRILIGFLVLWIGTNSRNTSMAMTCIAVGGITLFLGFTVQADMGCVVSWSGKELKCGSGIFVVDNVHTWTEQYKFQPESPARLASAILNAHKDGVCGIRSTTRLENVMWKQITNELNYVLWEGGHDLTVVAGDVKGVLTKGKRALTPPVSDLKYSWKTWGKAKIFTPEARNSTFLIDGPDTSECPNERRAWNSLEVEDYGFGMFTTNIWMKFREGSSEVCDHRLMSAAIKDQKAVHADMGYWIESSKNQTWQIEKASLIEVKTCLWPKTHTLWSNGVLESQMLIPKSYAGPFSQHNYRQGYATQTVGPWHLGKLEIDFGECPGTTVTIQEDCDHRGPSLRTSTASGKLVTQWCCRSCTMPPLRFLGEDGCWYGMEIRPLSEKEENMVKSQVTAGQGTSETFSMGLLCLTLFVEECLRRRVTRKHMILVVVITLCAIILGGLTWMDLLRALIMLGDTMSGRIGGQIHLAIMAVFKMSPGYVLGVFLRKLTSRETALMVIGMAMTTVLSIPHDLMELIDGISLGLILLKIVTQFDNTQVGTLALSLTFIRSTMPLIMAWRTIMAVLFVVTLIPLCRTSCLQKQSHWVEITALILGAQALPVYLMTLMKGASRRSWPLNEGIMAVGLVSLLGSALLKNDVPLAGPMVAGGLLLAAYVMSGSSADLSLEKAANVQWDEMADITGSSPIIEVKQDEDGSFSIRDVEETNMITLLVKLALITVSGLYPLAIPVTMTLWYMWQVKTQRSGALWDVPSPAATQKAALSEGVYRIMQRGLFGKTQVGVGIHMEGVFHTMWHVTRGSVICHETGRLEPSWADVRNDMISYGGGWRLGDKWDKEEDVQVLAIEPGKNPKHVQTKPGLFKTLTGEIGAVTLDFKPGTSGSPIINRKGKVIGLYGNGVVTKSGDYVSAITQAERIGEPDYEVDEDIFRKKRLTIMDLHPGAGKTKRILPSIVREALKRRLRTLILAPTRVVAAEMEEALRGLPIRYQTPAVKSEHTGREIVDLMCHATSTTRLLSSTRVPNYNLIVMDEAHFTDPSSVAARGYISTRVEMGEAAAIFMTATPPGATDPFPQSNSPIEDIEREIPERSWNTGFDWITDYQGKTVWFVPSIKAGNDIANCLRKSGKKVIQLSRKTFDTEYPKTKLTDWDFVVTTDISEMGANFRAGRVIDPRRCLKPVILTDGPERVILAGPIPVTPASAAQRRGRIGRNPAQEDDQYVFSGDPLKNDEDHAHWTEAKMLLDNIYTPEGIIPTLFGPEREKTQAIDGEFRLRGEQRKTFVELMRRGDLPVWLSYKVASAGISYKDREWCFTGERNNQILEENMEVEIWTREGEKKKLRPRWLDARVYADPMALKDFKEFASGRKSITLDILTEIASLPTYLSSRAKLALDNIVMLHTTERGGRAYQHALNELPESLETLMLVALLGAMTAGIFLFFMQGKGIGKLSMGLIIIAVASGLLWVAEIQPQWIAASIILEFFLMVLLIPEPEKQRTPQDNQLIYVILTILTIIGLIAANEMGLIEKTKTDFGFYQVKTETTILDVDLRPASAWTLYAVATTILTPMLRHTIENTSANLSLAAIANQAAVLMGLGKGWPLHRMDLGVPLLAMGCYSQVNPTTLTASLVMLSVHYAIIGPGLQAKATREAQKRTAAGIMKNPTVDGITVIDLEPISYDPKFEKQLGQVMLLVLCAGQLLLMRTTWAFCEVLTLATGPILTLWEGNPGRFWNTTIAVSTANIFRGSYLAGAGLAFSLIKNAQTPRRGTGTTGETLGEKWKRQLNSLDRKEFEEYKRSGILEVDRTEAKSALKDGSKIKHAVSRGSSKIRWIVERGMVKPKGKVVDLGCGRGGWSYYMATLKNVTEVKGYTKGGPGHEEPIPMATYGWNLVKLHSGVDVFYKPTEQVDTLLCDIGESSSNPTIEEGRTLRVLKMVEPWLSSKPEFCIKVLNPYMPTVIEELEKLQRKHGGNLVRCPLSRNSTHEMYWVSGASGNIVSSVNTTSKMLLNRFTTRHRKPTYEKDVDLGAGTRSVSTETEKPDMTIIGRRLQRLQEEHKETWHYDQENPYRTWAYHGSYEAPSTGSASSMVNGVVKLLTKPWDVIPMVTQLAMTDTTPFGQQRVFKEKVDTRTPQPKPGTRMVMTTTANWLWALLGKKKNPRLCTREEFISKVRSNAAIGAVFQEEQGWTSASEAVNDSRFWELVDKERALHQEGKCESCVYNMMGKREKKLGEFGRAKGSRAIWYMWLGARFLEFEALGFLNEDHWFGRENSWSGVEGEGLHRLGYILEEIDKKDGDLMYADDTAGWDTRITEDDLQNEELITEQMAPHHKILAKAIFKLTYQNKVVKVLRPTPRGAVMDIISRKDQRGSGQVGTYGLNTFTNMEVQLIRQMEAEGVITQDDMQNPKGLKERVEKWLKECGVDRLKRMAISGDDCVVKPLDERFGTSLLFLNDMGKVRKDIPQWEPSKGWKNWQEVPFCSHHFHKIFMKDGRSLVVPCRNQDELIGRARISQGAGWSLRETACLGKAYAQMWSLMYFHRRDLRLASMAICSAVPTEWFPTSRTTWSIHAHHQWMTTEDMLKVWNRVWIEDNPNMTDKTPVHSWEDIPYLGKREDLWCGSLIGLSSRATWAKNIHTAITQVRNLIGKEEYVDYMPVMKRYSAPSESEGVL

SEQ ID NO: 5273 - protein, 3288 aa, Artificial Sequence
  derived and/or modified protein sequence (wt) from DENV-4__AY947539__SS-prME
STMTLLCLIPTAMAFHLSTRDGEPLMIVARHERGRPLLFKTTEGINKCTLIAMDLGEMCEDTVTYECPLLVNTEPEDIDCWCNLTSAWVMYGTCTQSGERRREKRSVALTPHSGMGLETRAETWMSSEGAWKHAQRVESWILRNPGFALLAGFMAYMIGQTGIQRTVFFVLMMLVAPSYGMRCVGVGNRDFVEGVSGGAWVDLVLEHGGCVTTMAQGKPTLDFELIKTTAKEVALLRTYCIEASISNITTATRCPTQGEPYLKEEQDQQYICRRDVVDRGWGNGCGLFGKGGVVTCAKFSCSGKITGNLVQIENLEYTVVVTVHNGDTHAVGNDIPNHGVTATITPRSPSVEVKLPDYGELTLDCEPRSGIDFNEMILMKMKKKTWLVHKQWFLDLPLPWAAGADTSEVHWNYKERMVTFKVPHAKRQDVTVLGSQEGAMHSALTGATEVDSGDGNHMFAGHLKCKVRMEKLRIKGMSYTMCSGKFSIDKEMAETQHGTTVVKVKYEGAGAPCKVPIEIRDVNKEKVVGRIISSTPFAEYTNSVTNIELEPPFGDSYIVIGVGDSALTLHWFRKGSSIGKMLESTYRGAKRMAILGETAWDFGSVGGLLTSLGKAVHQVFGSVYTTMFGGVSWMVRILIGFLVLWIGTNSRNTSMAMTCIAVGGITLFLGFTVHADTGCAVSWSGKELKCGSGIFVIDNVHTWTEQYKFQPESPARLASAILNAHEDGVCGIRSTTRLENIMWKQITNELNYVLWEGGHDLTVVAGDVKGVLSKGKRALAPPVNDLKYSWKTWGKAKIFTPEAKNSTFLIDGPDTSECPNERRAWNFLEVEDYGFGMFTTNIWMKFREGSSEVCDHRLMSAAIKDQKAVHADMGYWIESSKNQTWQIEKASLIEVKTCLWPKTHTLWSNGVLESQMLIPKAYAGPFSQHNYRQGYATQTVGPWHLGKLEIDFGECPGTTVTIQEDCDHRGPSLRTTTASGKLVTQWCCRSCTMPPLRFLGEDGCWYGMEIRPLSEKEENMVKSQVSAGQGTSETFSMGLLCLTLFVEECLRRRVTRKHMILVVVTTLCAIILGGLTWMDLLRALIMLGDTMSGRMGGQIHLAIMAVFKMSPGYVLGIFLRKLTSRETALMVIGMAMTTVLSIPHDLMEFIDGISLGLILLKMVTHFDNTQVGTLALSLTFIRSTMPLVMAWRTIMAVLFVVTLIPLCRTSCLQKQSHWVEITALILGAQALPVYLMTLMKGASKRSWPLNEGIMAVGLVSLLGSALLKNDVPLAGPMVAGGLLLAAYVMSGSSADLSLEKAANVQWDEMADITGSSPIIEVKQDEDGSFSIRDIEETNMITLLVKLALITVSGLYPLAIPVTMTLWYMWQVKTQRSGALWDVPSPAAAQKATLTEGVYRIMQRGLFGKTQVGVGIHMEGVFHTMWHVTRGSVICHETGRLEPSWADVRNDMISYGGGWRLGDKWDKEEDVQVLAIEPGKNPKHVQTKPGLFKTLTGEIGAVTLDFKPGTSGSPIINRKGKVIGLYGNGVVTKSGDYVSAITQAERTGEPDYEVDEDIFRKKRLTIMDLHPGAGKTKRILPSIVREALKRRLRTLILAPTRVVAAEMEEALRGLPIRYQTPAVKSEHTGREIVDLMCHATFTTRLLSSTRVPNYNLIVMDEAHFTDPSSVAARGYISTRVEMGEAAAIFMTATPPGATDPFPQSNSPIEDIEREIPERSWNTGFDWITDYQGKTVWFVPSIKAGNDIANCLRKSGKKVIQLSRKTFDTEYPKTKLTDWDFVVTTDISEMGANFRAGRVIDPRRCLKPVISTDGPERVILAGPIPVTPASAAQRRGRIGRNPAQEDDQYVFSGDPLKNDEDHAHWTEAKMLLDNIYTPEGIIPTLFGPEREKNQAIDGEFRLRGEQRKTFVELMRRGDLPVWLSYKVASAGISYKDREWCFTGERNNQILEENMEVEIWTREGEKKKLRPKWLDARVYADPMALKDFKEFASGRKSITLDILTEIASLPTYLSSRAKLALDNIVMLHTTERGGKAYQHALNELPESLETLMLVALLGAMTAGIFLFFMQGKGIGKLSMGLIAIAVASGLLWVAEIQPQWIAASIILEFFLMVLLIPEPEKQRTPQDNQLIYVILTILTIIGLIAANEMGLIEKTKTDFGFYQVKTETTILDVDLRPASAWTLYAVATTILTPMLRHTIENTSANLSLAAIANQAAVLMGLGKGWPLHRMDLGVPLLAMGCYSQVNPTTLIASLVMLLVHYAIIGPGLQAKATREAQKRTAAGIMKNPTVDGITVIDLEPISYDPKFEKQLGQVMLLVLCAGQLLLMRTTWAFCEVLTLATGPVLTLWEGNPGRFWNTTIAVSTANIFRGSYLAGAGLAFSLIKNAQTPRRGTGTTGETLGEKWKRQLNSLDRKEFEEYKRSGILEVDRTEAKSALKDGSKIKHAVSRGSSKIRWIVERGMVKPKGKVVDLGCGRGGWSYYMATLKNVTEVKGYTKGGPGHEEPIPMATYGWNLVKLHSGVDVFYKPTEQVDTLLCDIGESSSNPTIEEGRTLRVLKMVEPWLSSKPEFCIKVLNPYMPTVIEELEKLQRKHGGSLVRCPLSRNSTHEMYWVSGVSGNIVSSVNTTSKMLLNRFTTRHRKPTYEKDVDLGAGTRSVSTETEKPDMTIIGRRLQRLQEEHKETWHYDQENPYRTWAYHGSYEAPSTGSASSMVNGVVKLLTKPWDVIPMVTQLAMTDTTPFGQQRVFKEKVDTRTPQPKPGTRMVMTTTANWLWALLGKKKNPRLCTREEFISKVRSNAAIGAVFQEEQGWTSASEAVNDSRFWELVDKERALHQEGKCESCVYNMMGKREKKLGEFGRAKGSRAIWYMWLGARFLEFEALGFLNEDHWFGRENSWSGVEGEGLHRLGYILEDIDKKDGDLIYADDTAGWDTRITEDDLLNEELITEQMAPHHKILAKAIFKLTYQNKVVKVLRPTPKGAVMDIISRKDQRGSGQVGTYGLNTFTNMEVQLIRQMEAEGVITQDDMHNPKGLKERVEKWLKECGVDRLKRMAISGDDCVVKPLDERFSTSLLFLNDMGKVRKDIPQWEPSKGWKNWQEVPFCSHHFHKIFMKDGRSLVVPCRNQDELIGRARISQGAGWSLRETACLGKAYAQMWSLMYFHRRDLRLASMAICSAVPTEWFPTSRTTWSIHAHHQWMTTEDMLKVWNRVWIEDNPNMTDKTPVHSWEDIPYLGKREDLWCGSLIGLSSRATWAKNIHTAITQVRNLIGKEEYVDYMPVMKRYSAPFESEGVL

SEQ ID NO: 5274 - RNA, 9879 nt, Artificial Sequence
  derived and/or modified CDS sequence (wt) from DENV-1__AB608789__SS-prME
ucugugaccaugcuccuuaugcugaugcccacagccuuggcguuccaucugacuacacgagggggagagccgcacaugauagucaccaagcaggaaagaggaaagucacuuuuguuuaagaccucagcaggugucaacaugugcacccuuauagcgauggauuugggagaguuaugugaggacacaaugacuuacaaaugcccucgaauuacugaggcggaaccagaugacauugauuguuggugcaaugccacagacacaugggugaccuauggaacauguucccaaacuggcgagcaccgacgagacaaacguuccgucgcacuggccccacacguaggacuugguuuggaaacaagaaccgaaacguggauguccucugaaggcgcuuggaaacagauacaaagaguggagacuugggcccugagacacccaggauucacggugauagcccuuuuucuagcacaugccauaggaacauccaucacccagaaagggaucauuuucauuuuguuaaugcugguaacaccauccauggccaugcgaugcgugggaauaggcagcagggacuucguggaaggacugucaggagcaacuuggguagacgugguacuggaacauggaaguugcgucaccaccauggcaaaagacaaaccaacauuggacauugaacucuugaagacggaagucacaaacccugccguccugcgcaaacugugcauugaagcuaaaauaucaaacaccacuaccgacucaagauguccaacacaaggagaagccacacugguggaagaacaagacgcgaacuuugugugucgacgaacguuuguggacagaggcuggggcaauggcuguggucucuucggaaaaggaagccuaauaacgugugcuaaguucaagugugugacaaaacuggaaggaaagauaguucaauaugaaaacuugaaauauucaguaauagucaccguccacacuggagaccaacaccaggugggaaaugaaagcacagaacaugggacaacugcaacuauaacaccucaagcuccuacgucggaaauacagcugaccgacuacggagcucuuacauuggauugcucaccuagaacaggacuagacuuuaaugaaaugguguuguugacaaugaaagagaaaucauggcuaguccacaaacaaugguuucuagaccuaccacugccuuggaccucaggagcuucaacaucacaagagacuuggaacagacaagauuugcuggugacauuuaagacagcucaugcaaagaagcaggaaguagucguacuaggaucacaagaaggagcaaugcacacugcguugaccggagcgacagaaauccaaacgucuggaacgacaacaauuuuugcaggacaccugaaauguagacuaaagauggacaaacugacucuaaaagggaugucauaugugaugugcacaggcucauucaagcuagagaaagaaguggcugagacccagcauggaaccguucuagugcagauuaaauacgaaggaacagaugcaccaugcaagaucccuuuuucgacccaagaugaaaaaggaguaacccagaaugggagauugauaacagcuaacccuauagucacugacaaagaaaaaccagucaacauugaggcagaaccgccuuuuggugagaguuacauugugauaggagcaggugaaaaagcuuugaaacuaagcugguucaagagaggaagcagcauagggaaaauguuugaggcaacugccagaggagcacgaaggauggccauacugggagacaccgcaugggacuuugguucuauaggaggaguguucacaucuguuggaaaacuaguacaccagauuuuuggaacugcauauggaguuuuguucagcgguguuuccuggaccaugaaaauaggaauagggguucuguugacauggcuaggauuaaacucaaggagcacgucccuuucgaugacgugcauugcaguuggccuaguaacacuauaccuaggagucaugguucaggcggauucaggauguguaauaaauuggaaagguagagaacucaaauguggaaguggcauuuuugucaccaaugaaguucacacuuggacagagcaauacaaauuucaagcugacuccccaaagagacuaucagcagccaucgggaaggcaugggaggaggguguguguggaauucgaucagccacucgucucgagaauaucauguggaagcaaauaucaaacgaacugaaccacaucuuacuugaaaaugacaugaaauucacagugguuguaggagauguuguugggaucuuggcucaagggaaaaaaaugauuaggccacaacccauggaauacaaauacuccuggaaaagcuggggaaaagcuaaaaucauaggggcagauguacagaacaccaccuucaucauugacggcccaaacaccccagaaugcccugaugaucaaagagcauggaacauuugggaaguugaggacuauggauuuggaauuuucacgacaaacauaugguugaaauugcgugacucuuacacccaagugugugaccaccggcuaaugucagcugccaucaaggacagcaaggcaguucaugcugacaugggguacuggauagaaagugaaaagaacgagaccuggaagcuggcaagagccucuuucauagaaguuaaaacauguaucuggccaaaaucccacacucuauggagcaauggaguucuggaaagugaaaugauaauuccaaagaucuauggaggaccaauaucucagcacaacuacagaccaggauauuucacacaaacggcagggccguggcaccuaggcaaguuggaacuggauuuugauuugugugaggguaccacaguuguuguggaugaacauuguggaaaucggggaccaucucuuagaaccacaacagucacaggaaagauaauucaugaaugguguugcagaucuuguacgcuaccacccuuacguuucaaaggagaagauggguguugguacgguauggaaaucagaccagucaaggaaaaggaagagaaucuagucaaaucaauggucucugcagggucaggggaaguggacagcuuuucacuaggacugcuaugcaugucaauaaugaucgaagaggugaugagauccagauggaguagaaaaaugcugaugacuggaacacuggcuguguuccuccuucucauaaugggacaauugacauggaaugaucugaucagguuaugcaucaugguuggagccaacgcuuccgacaggauggggaugggaacgacguaccuagcucugauggccacuuuuaaaaugagaccaauguuugcugucgggcuauuauuccgcagacuaacauccagagaaguucuucuucuuacaauuggauugagucuaguggcaucuguggaguuaccaaauuccuuggaggagcugggggauggacuugcaaugggcauuaugauucuaaaauuauugacugacuuucagucacaucagcugugggcuaccuugcuguccuugacauucaucaaaacaacgguuuccuugcacuaugcauggaagacaauggcuaugguacugucaauuguaucucucuuccccuuaugccuguccacgaccucccaaaaaacaacauggcuuccggugcuauugggaucucuuggaugcaaaccacuaaccauguuucuuauagcagaaaacaaaaucuggggaaggaaaaguuggccccucaaugaaggaaucauggcuguuggaauagucagcauccuacuaaguucacuccucaaaaaugaugugccgcuagcugggccacuaauagcuggaggcaugcuaauagcauguuauguuauaucuggaagcucagccgacuugucauuagagaaagcggcugaggucuccugggaagaagaagcagaacacucuggugccucacacaauauauuaguggagguccaagaugacggaaccaugaagauaaaggaugaagagagagaugacacgcuaaccauucuccuuaaagcaacucugcuagcaguuucagggguguacccauuaucaauaccagcgacccuuuuugugugguacuuuuggcagaaaaagaaacagagaucuggaguguuaugggacacacccagcccuccagaaguggaaagagcaguucuugaugaagguaucuauagaauuaugcagagaggacuguugggcaggucccaaguagggguaggaguuuuccaagaaaacguguuccacacaauguggcaugucaccaggggagcuguacucauguaucaagggaagagacuggaaccgaguugggccagugucaaaaaagaccugaucucauauggaggagguuggaggcuucaaggauccuggaacacgggagaagaagugcaggugauugcuguugaaccagggaaaaaccccaaaaauguacaaacagcgccgggcaccuucaagaccccugaaggugaaguuggagccauugcccuagauuuuaaacccggcacaucuggaucucccauugugaacagagaaggaaaaauaguaggucuuuauggaaauggaguagugacaacaaguggaaccuacgucagugccauagcucaagccaaagcaucacaagaagggccccuaccagagauugaagacgagguguuuaggaaaagaaacuuaacaauaauggaccuacauccaggaucgggaaaaacaagaagauaucuuccagccauaguccgugaggccauaaaacggaagcugcgcacacuaauuuuggcucccacaaggguugucgcuuccgaaauggcagaggcgcuuaaaggaaugccaauaagguaccaaacaacagcagugaagagugaacacacaggaaaagagauaguugaucucaugugucacgccacuuucaccaugcgucuccugucucccgugagaguucccaauuacaacaugauuaucauggaugaagcacauuucaccgauccauccagcauagcggccagaggguacaucucaacccgagugggcaugggugaagcagcugcgaucuucaugacagccacucccccaggaucaguggaggccuuuccacagagcaaugcaguuauccaagaugaggaaagagacauuccugagagaucauggaacucaggcuaugaguggaucacugacuucccagguaaaacaguuugguuuguuccaagcaucaaaucaggaaaugacauugccaacugcuuaagaaagaaugggaaacgggugauucaauugagcaggaaaaccuuugauacagaguaccaaaaaacaaaaaauaacgacugggauuaugucgucacaacagacaucuccgaaaugggagcaaacuuccgagccgacagggugauagacccaagacggugucugaaaccgguaauacuaaaagaugguccagagcguguuauucuagcaggaccgaugccagugacuguggccagugcugcccagaggagaggaagaauuggaaggaaccacaauaaggaaggugaucaguacaucuacaugggacagccuuuaaacaacgaugaagaucacgcucacuggacagaagcaaaaaugcuccuugauaauauaaacacaccagaagggauuaucccagcccucuucgagccggagagagaaaagagugcagcaauagacggggaauacagauugcggggugaagcaaggaagacguuuguggagcucaugagaagaggagaucuaccugucuggcuauccuacaaaguugccucagaaggcuuccaguacucugacagaagauggugcuuugacggggaaaggaacaaccagguguuggaggagaacauggacguggagaucuggacaaaagaaggagaaagaaagaaacuacgaccccgcuggcuggaugccagaacauacucagacccacuagcccugcgcgaguuuaaggaguuugcagcaggaagaagaagcgucucaggugaucuaauauuagaaauagggaaacuuccacaacacuugacgcaaagggcccagaaugccuuggacaaccuggucauguugcacaacuccgaacaaggaggaagagcuuauagacaugcaauggaagaacugccagacaccauagaaacguugaugcuccuagcuuugauagcuguguugacugguggagugacgcuguucuuccuaucaggaaggggccuagggaaaacaucuaucggccuacucugcgugauggcuucaagcguacugcuauggauggccaguguggagccccauuggauagcggccuccaucauacuggaguucuuccugauggugcugcuuauuccagagccagacagacaacgcacuccgcaggacaaccagcuggcauauguggugauagguuuguuauucaugauacugacaguagcagccaaugagaugggauuauuggaaaccacaaagaaagacuuagggauuggccauguggcuguugaaaaucaccaccaugccacaauguuggacguagacuuacauccagcuucagccuggacccucuaugcaguggccacaacaauuaucacucccaugaugaggcacacaaucgaaaacacaacggcaaacauuucccugacagcuauugcaaaccaggcagcuauauugaugggacuugacaaaggauggccaauaucgaagauggacauaggaguuccacuucucgccuuggggugcuacucacaggugaauccauugacgcugacagcggcgguauugaugcuaguggcucauuacgccauaauuggaccuggacugcaagcaaaagcuacuagagaagcucaaaaaaggacagcggccggaauaaugaaaaauccaaccguugauggaauuguugcaauagauuuggacccugugguuuaugaugcaaaauuugagaaacaacuagggcaaauaauguuguugauacuauguacaucacagauccucuugaugcggacuacaugggccuugugcgaauccaucacacuggccacuggaccucugaccacgcuuugggagggaucuccaggaaaauuuuggaacaccacgauagcgguuuccauggcaaacauuuucagaggaaguuaucuagcaggagcaggucuggccuucucauuaaugaaaucucuaggaggagguaggagagguacgggagcccaaggggaaacauugggagagaaauggaaaagacagcugaaccaacugagcaagucagaauucaacacuuacaaaagaagugggauuauggaaguggacagauccgaagccaaagagggagugaaaagaggagaaacaaccaaacaugcagugucgagaggaaccgccaaacugaggugguuuguggagaggaaccuugugaaaccagaagggaaagucauagaccucgguuguggaagagguggcuggucauacuauugcgcugggcugaagaaagucacagaagugaagggauauacaaaaggaggaccuggacaugaggaaccaaucccaauggcgaccuauggauggaaccuaguaaaacugcacuccgggaaagacguauucuuuacaccaccugagaaaugugacacucuuuugugugauauuggugaguccucuccaaacccaacuauagaagaaggaagaacguuacgcguccuaaagaugguggaaccauggcucagaggaaaccaauuuugcauaaaaauucuaaaucccuacaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacaucuagaauguugcuaaaucgauucacaauggcucacaggaaaccaacauaugaaagagacguggaccuaggcgcuggaacaagacauguggcaguggaaccagagguagccaaccuagauaucauuggccagaggauagagaacauaaaacaugaacauaagucaacauggcauuaugaugaggacaauccauauaaaacaugggccuaucauggaucauaugaggucaagccaucaggaucagccucauccauggucaauggcguggugaaacugcucaccaaaccaugggaugucauccccauggucacacaaauagcuaugacugacacuacacccuuuggacaacagaggguguuuaaagagaaaguugacacgcgcacaccaaaagcaaaacgaggcacagcacaaaucauggaggugacagccaggugguuaugggguuuucuuucuagaaacaaaaaaccaagaauuuguacaagagaggaguucacaagaaaaguuaggucaaacgcagccauuggagcaguguucguugaugaaaaucaauggaacucagcaaaagaagcaguggaagaugagcgguucugggaccuugugcacagagagagagagcuucacaaacagggaaaaugugccacguguguuuacaacaugauggggaagagagagaaaaaacuaggagaguucggaaaggcgccagaaagucgugcaauaugguacaugugguugggagcacgcuuucuagaguucgaagcucuugguuucaugaacgaagaucacugguucaguagagagaauucacucagcggaguggaaggagaaggacuccacaaacucggauacauacucagagacauaucaaagauuccagggggaaauauguaugcagaugacacagccggaugggacacaagaauaacagaggaugaccuucagaaugaggccaaaauuacugacaucauggagcccgaacaugcccuacuggcuacgucaaucuucaagcugaccuaucaaaauaaggugguaaggguacagagaccagcaaaaaauggaaccgugauggaugucauauccagacgugaccagagaggaaguggccaggucggaacuuauggcuuaaacacuuucaccaacauggaagcucagcuaauaagacaaauggagucugagggaaucuuuucauccagcgaauuggagaccccaaauuuagccgagagaguucucgacuggcugggaaaauauggcgucgaaaggcugaaaagaauggcaaucagcggagaugacugcguggugaaaccaauugaugacagguucgcaacagccuuaacagcucugaaugaugugggaaaaguaagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaagucauaugcacaaauguggcagcugauguacuuccacaggagagaccugagacuagccgcuaaugcuaucuguucagccguuccaguugauugggucccaaccagccgcaccaccuggucgauccaugcccaucaccaauggaugacaacagaagacauguugucaguguggaauaggguuuggauagaggaaaacccauggauggaggacaaaacccauguguccaguuggggagauguuccauauuuaggaaaaagggaagaucagugguguggaucccugauaggcuuaacagcaagggccaccugggccaccaacauacaaguggccauaaaccaagugagaagacuaauugggaaugagaauuaucuagauuacaugacaucaaugaagagauucaagaacgagagugauccugaaggggcacucugguga

SEQ ID NO: 5275 - RNA, 9879 nt, Artificial Sequence
  derived and/or modified CDS sequence (wt) from DENV-1__AB608788__SS-prME
uccgugaccaugcuccuuaugcugcugcccacagucuuggcguuucaucugaccacacgagggggagagccgcauaugauaguuaccaagcaggaaagaggaaagucacuuuuguuuaagaccucagcuggugucaacaugugcacccuuauugcgauggauuugggagaguuaugugaggacacaaugacuuacaaauguccucgaaucacugaggcggaaccagaugacguugauuguuggugcaaugccacagacacaugggugaccuauggaacguguucccaaacuggcgagcaucgacgagacaaacguuccgucgcacuggcuccacacgugggacuuggucuagaaacaagaaccgaaacguggauguccucugaaggcgcuuggaaacaaauacaaagaguggagacuugggcccugagacacccaggauucacagugauagcccuuuuucuagcacaugccauaggaacauccaucacccagaaagggauuauuuucauuuuguugaugcugguaacaccauccauggccaugcgaugugugggaauaggcaacagggacuuuguggaaggacugucgggagcaacguggguagaugugguacuggaacauggaagcugugucaccaccauggcaaaagauaaaccaacauuggacauugaacucuugaagacggaagucacaaacccugccguccugcgcaaacugugcauugaagcuaaaauaucaaacaccaccaccgauucaagauguccaacacaaggagaagccacacugguggaagaacaagacgcgaauuuugugugucgacgaacguuuguggacagaggcuggggcaauggcugugggcuuuucgggaaagguagccuaauaacgugugcuaaguucaagugugugacaaaacuggaaggaaagauaguucaauaugaaaacuugaaauacucaguaauagucaccguccacacuggagaccagcaccaggugggaaaugaaagcacagaacaugggacaacagcaacuauaacaccucaagcucccacgucggaaauacagcugaccgacuacggagcucuuacauuggauugcucaccuagaacaggacuagacuucaaugaaaugguguuguugacaaugaaagaaaaaucauggcuaguccacaaacaaugguuucuagaccuaccacugccuuggaccucgggagcuacaacgucacaagagacuuggaacagacaagauuugcugguaacauucaagacagcucaugcaaagaagcaggaaguagucguacuaggaucacaagaaggagcaaugcacacugcguugaccggagcgacagaaauccaaacgucuggaacgacaacaauuuuugcaggacacuugaaauguagacuaaaaauggacaaacugacucuaaaagggaugucauaugugaugugcacaggcucauucaagcuagagaaagagguggcugagacccagcauggaaccguucuagugcagguuaaauacgaaggaacagaugcaccaugcaagaucccuuuuucgacccaagaugaaaaaggaguaacccagaaugggagagugauaacagccaacccuauagucacugacaaggaaaaaccagucaacauugaggcagaaccaccuuuuggugagaguuacaucgugguaggagcaggugaaaaagcuuugaaacuaagcugguucaagaaaggaagcaccauagggaaaauguuugaggcaacugcccgaggagcacgaaggauggccauacugggagacaccgcaugggacuuugguuccauaggaggaguguucacaucuguuggaaaacuaguacaccagauuuuuggaacugcauauggaguuuuguucagcgguguuuccuggaccaugaaaauaggaauagggguucugcugacauggcuaggauuaaacucaaggagcacgucccuuucgaugacgugcauugcaguuggccugguaacacuguaccuaggagucaugguucaggcggauucgggauauguaaucaacuggaaaggcagagaacucaaauguggaaguggcauuuuugucaccaaugaaguucacacuuggacagagcaauacaaauuucaggcugacuccccaaaaagacuaucagcagccaucgggaaggcaugggaggaggguguguguggaauucgaucagccacucgucucgagaacaucauguggaagcaaauaucaaaugaacugaaccacaucuuacuugaaaaugacaugaaauucacaguggucguaggagauguuagugggaucuuggcccaagggaaaaaaaugauuaggccacaacccauggaacacaaauacucguggaaaagcuggggaaaagcuaaaaucauaggggcagauguacagaacuccaccuucaucauugacggcccaaacaccccagaaugccccgaugaucaaagagcauggaacauuugggaaguugaggacuauggauuuggaauuuucacgacaaacauaugguugaaauugcgugacuccuacacccaagugugugaccaccggcuaaugucagcugccaucaaggacagcaaggcaguucaugcugacaugggguacuggauagaaagugaaaagaacgagacuuggaagcuggcaagagccuccuucauagaaguuaaaacaugcguuuggccaaaaucccacacucuauggagcaauggaguucuggaaagugaaaugauaauuccaaagauauauggaggaccaauaucucagcacaacuacagaccaggauauuucacacaaacaucagggccguggcacuuaggcaaguuggaacuagauuuugauuugugugaggguaccacaguuguuguggaugaacauuguggaaaucgaggaccaucucuuagaaccacaacagucacaggaaaaauaauccaugaauggugcugcagaucuuguacgcuaccacccuuacguuuuaaaggagaagauggguguugguaugguauggaaauuagaccagucaaggaaaaggaagagaaucuaguuaaaucaauggucucugcagggucaggagaaguggacagcuuuucacuaggacugcuaugcauaucaauaaugauugaagaggugaugagaucuagauggaguagaaaaaugcugaugacuggaacacuggcuguguuccuccuucucauaaugggacaauugacauggaaugaucugaucagguuaugcaucaugguuggagccaaugcuucagacaggauggggaugggaacaacguaccuagcucugauggccacuuuuaaaaugagaccaauguuugcugucgggcuauuguuccgcagacuaacaucuagagaaguucuucuucuuacaauuggauugagucuaguggcauccguggagcuaccaaauuccuuggaggagcugggggauggacuugcaaugggcauuaugaucuuaaaauuacugacugauuuucagucacaucagcugugggcugccuugcugucccugacauuuaucaaaacaacuuuuucuuugcacuaugcauggaagacaauggcuaugguacugucaauugugucucucuuccccuuaugccuguccacgaccucucaaaaaacaacauggcuuccggugcuauugggaucucuuggaugcaaaccacuaaccauguuucucauagcagaaaacaaaaucuggggaaggaaaaguuggccucucaaugaaggaaucauggcuguuggaauagucagcaucuuacuaaguucacuccucaagaaugaugugccgcuagcugggccacuaauagcuggaggcaugcuaauagcauguuauguuauaucuggaagcucagcugauuuaucacuagagaaagcggcugaggucuccugggaagaagaagcagaacacucuggugccucacacaauauauuaguggagguccaagaugauggaaccaugaagauaaaagaugaagagagagaugacacacuaaccauucuccuuaaagcaacucugcuggcaguuucagggguguacccauuaucaauaccagcgacccuuuuugugugguauuuuuggcagaaaaagaaacagagaucaggaguguuaugggacacaccuagcccuccagaaguggaaagagcaguucuugaugaugguaucuauagaauuaugcagagaggacuguugggcagaucccaaguagggguaggaguuuuccaagaaaacguguuccacacaauguggcaugucaccaggggagcuguacucauguaucaagggaagagacuggaaccgaguugggcuagugucaaaaaagaccugaucucauauggaggagguuggaggcuucaaggauccuggaacacgggagaagaagugcaggugauugcuguugaaccagggaaaaaccccaaaaauguacagacagcgccgggcaccuucaagaccccugaaggugaaguuggagccauagcccuagauuuuaaacccggcacaucuggaucccccaucgugaacagagaggggaaaauaguaggucuuuauggaaauggaguagugacaacaaguggaaccuacgucagugccauagcucaagcuaaagcaucacaagaagggccccuaccagagauugaggacgagguguuuaggaaaagaaacuuaacaauaauggaccuacauccaggaucaggaaaaacaagaagauaucuuccagccauaguccgugaggccauaaaaaggaagcugcgcacacuaauuuuggcucccacaagaguugucgcuuccgaaauggcagaggcgcucaagggaaugccgauaagguaucagacaacagcagugaagagugaacacacaggaaaggagauaguugaccucaugugccacgccacuuucacuaugcgucuucugucuccugugagaguucccaauuacaacaugauuaucauggaugaagcacauuucaccgauccauccagcauagcggccagaggguacaucucaacccgaguggguaugggugaagcagcugcgaucuuuaugacagccacucccccaggaucaguggaggccuuuccacagagcaaugcaguuauccaagaugaggaaagagacauuccugagagaucauggaacucaggcuaugacuggaucacugacuucccagguaaaacagucugguuuguuccaagcaucaaaucaggaaaugacauugccaacuguuuaagaaagaaugggaaacgggugauucaauugagcagaaaaaccuuugacacagaguaccaaaagacaaaaaacaacgacugggacuaugucgucacaacagacaucuccgaaaugggagcuaacuuccgagccgacaggguaauagacccaagacggugucugaaaccgguaauacuaaaagaugguccagagcgugucauucuagcaggaccgaugccagugacuguggccagugcugcccagaggagaggaagaaucggaaggaaccaaaauaaggaaggugaucaguacaucuacaugggacagccuuuaaacaacgaugaagaccacgcucauuggacagaagcaaaaaugcuccuugacaauauaaacacaccagaagggauuaucccagcccucuuugaaccggagagagaaaagagugcggcaauagacggggaauauagacugcggggugaggcaaggaaaacguuuguggagcucaugagaagaggggaucuaccugucuggcuauccuacaaaguugccucagaaggcuuccaguacucugacagaagauggugcuuugauggggaaaggaacaaucagguguuggaggagaacauggacguggagaucuggacaaaagaaggagaaagaaagaaacuacgaccccgcuggcuugaugccagaacauacucagacccauuggcccugcgcgaguuuaaagaguuugcagcaggaagaagaagcgucucaggugaucuaauauuagaaauagggaaacuuccacagcacuugacgcaaagggcccagaaugccuuggacaaccuggucauguugcacaacuccgaacaaggaggaagagccuacagacaugcaauggaagaacucccagacaccauagaaacguugaugcuccuagcuuugauagcuguguuaacugguggagugacgcuguucuuccuaucaggaaggggcuuagggaaaacaucuaucggccuacuuugcgugauggcuucaagcgugcuguuauggauggccaguguggagccccauuggauagcggccuccaucauacuggaguucuuccugauggugcugcuuauuccagagccagacagacaacgcacuccacaggacaaccaguuggcauauguagugauagguuuguuauucaugauacugacaguagcagccaaugagaugggauuacuggaaaccacaaagaaagacuuagggauuggccauguggcuguugaaaaucaccaccaugccacaaugcuggacguagacuuacauccagcuucagccuggacccucuaugcaguggccacaacaauuaucacccccaugaugaggcacacaaucgaaaacacaacggcaaauauuucccugacagcuauugcaaaccaggcagccauauugaugggacucgacaaaggauggccaauaucgaagauggacauaggaguuccacuucucgccuuggggugcuacucccaggugaauccacugacgcugacagcggcaguauugauguuaguggcucauuacgccauaauuggaccuggacugcaagcaaaagcuacuagagaagcccaaaaaaggacagcggccggaauaaugaagaauccaacugucgauggaauaguugcaauagauuuggacccugugguuuaugaugcaaaauuugaaaaacaacuaggccaaauaauguuguugauacuaugcacaucacagauccucuugaugcggacuacaugggccuugugugaauccaucacacuggcuacuggaccucugaccacgcuuugggagggaucuccaggaaaauuuuggaacaccacgauagccguguccauggcaaacauauucaggggaaguuaucuagcaggagcaggccuggccuucucacuaaugaaaucucuaggaggagguaggagagguacgggagcccaaggggaaacauugggagaaaaauggaaaagacagcuaaaccaacugagcaagucagaauucaacacuuacaaaaggagugggauuauagaaguggauagauccgaagccaaagagggacugaaaagaggagaaacaaccaaacaugcagugucgagaggaaccgccaaacugaggugguuuguggagaggaaccuugugaaaccagaagggaaagucauagaccucgguuguggaagagguggcuggucauauuauugcgccgggcugaagaaagucacagaagugaagggauacacaaaaggaggagcuggacaugaggaaccaaucccaauggcgaccuauggauggaaccuaguaaagcuauacuccgggaaagacguauucuuuacaccaccugaaaaaugugacacccuuuugugugacauuggugaguccucuccgaacccaaccauagaagaaggaagaacguuacguguccuaaagaugguggaaccauggcuccgaggaaaccaauuuugcauaaaaauucuaaaucccuacaugccaagugugguggaaacucuggagcaaaugcaaagaaaacauggaggaaugcuagugcgaaacccacuuucaagaaauuccacucaugaaauguauuggguuucauguggaacaggaaacauugugucagcaguaaacaugacaucuagaauguugcuaaaucgauucacaauggcucacaggaaaccaacauaugaaagagacguggacuuaggcgcuggaacaagacauguggcaguggaaccagagguagccaaccuagauaucauuggccagaggauagagaacauaaaacaugaacauaagucaacauggcauuaugaugaggacaauccauacaagacaugggccuaucauggaucauaugaggucaagccaucaggaucagccucauccauggucaauggcguggugagacugcucaccaaaccaugggaugucauucccauggucacacaaauagccaugacugacaccacacccuuuggacaacagaggguguuuaaagagaaaguugacacgcgcacaccaaaagcgaaacaaggcacagcacaagucauggaggugacagcuaggugguuaugggguuuucuuucuagaaacaaaaaaccaagaaucugcacaagagaggaguucacaagaaaaguuaggucaaacgcagccauuggagcaguguucguugaugaaaaucaauggaacucugcaaaagaagcaguggaagaugagcgguuuugggaccuugugcacagagagagggagcuucacaaacagggaaaaugugccacauguguuuacaauaugauggggaaaagagagaaaaaacuaggagaguucggaaaggcaaaaggaagucgugcaauaugguacaugugguugggagcacgcuuucuagaguuugaagcccuugguuucaugaacgaagaucacugguucaguagagagaauucacucaguggaguggaaggagaaggacuccacagacucggauauauacucagagacauaucaaagauuccagggggaaauauguaugcagaugacacagccggaugggauacaaggauaacagaggaugaucuucagaaugaagccaaaaucacugacaucauggagcccgaacaugcccuacuggcuacgucaaucuucaagcugaccuaccaaaauaagguggugagggugcagagaccagcaaaaaauggaaccgugauggauguuauauccagacgugaccagagaggaaguggccaggucggaacuuauggcuuaaacacuuucaccaacauggaggcccagcuaauaagacaaauggagucugagggaaucuuuucacccagcgaauuagagaccccaaauuuggccgagagaguucucgacugguuggaaaaauauggcgucgaaaggcugaaaagaauggcaaucagcggagaugacugcguggugaagccaauugaugacagguucgcaacagcccuaacagcucugaacgauaugggaaaaguaaggaaagacauaccacaaugggaaccuucaaaaggauggaaugacuggcaacaagugccuuuuuguucacaccauuuccaccagcugauuaugaaggaugggagggaaauaguggugccaugccgcaaccaagaugaacuuguggguagggcuagagugucacaaggugccggauggagccugagagaaacugcaugccugggcaagucauaugcacaaauguggcagcugauguacuuccacaggagagaccugagacuagcugcuaaugccaucuguucagccguuccaguugauugggucccaaccagccgcaccacuuggucgauccaugcccaucaucaauggaugacaacagaaaacauguugucaguguggaauaggguuuggauagaggaaaacccauggauggaggacaaaacccauguguccaguugggaagauguuccauauuuagggaaaagggaagaucaguggugugguucccugauaggcuuaacagcaagggccaccugggccacuaacauacaaguggccauaaaccaagugagaaggcuaauugggaaugagaauuaucuagauuauaugacaucaaugaagagauucaagaacgauagcgaucccgaaggggcacucugguga
